US009403904B2

(12) United States Patent
Smider et al.

(10) Patent No.: US 9,403,904 B2
(45) Date of Patent: Aug. 2, 2016

(54) ANTI-DLL4 ANTIBODIES AND USES THEREOF

(75) Inventors: Vaughn Smider, San Diego, CA (US); Helen Hongyuan Mao, San Diego, CA (US); Cornelia Bentley, San Diego, CA (US); Tyson Chase, San Diego, CA (US)

(73) Assignee: Fabrus, Inc., La Jolla, CA (US)

( * ) Notice: Subject to any disclaimer, the term of this patent is extended or adjusted under 35 U.S.C. 154(b) by 1031 days.

(21) Appl. No.: 13/128,236

(22) PCT Filed: Nov. 4, 2009

(86) PCT No.: PCT/US2009/063303
§ 371 (c)(1),
(2), (4) Date: May 7, 2011

(87) PCT Pub. No.: WO2010/054010
PCT Pub. Date: May 14, 2010

(65) Prior Publication Data
US 2011/0318339 A1  Dec. 29, 2011

Related U.S. Application Data

(60) Provisional application No. 61/198,764, filed on Nov. 7, 2008, provisional application No. 61/211,204, filed on Mar. 25, 2009.

(51) Int. Cl.
| | | |
|---|---|---|
| *C07K 16/00* | (2006.01) |
| *C07K 16/22* | (2006.01) |
| *C40B 50/08* | (2006.01) |
| *C07K 16/18* | (2006.01) |
| *C07K 16/28* | (2006.01) |
| *C40B 40/08* | (2006.01) |

(52) U.S. Cl.
CPC ............. *C07K 16/22* (2013.01); *C07K 16/00* (2013.01); *C07K 16/18* (2013.01); *C07K 16/28* (2013.01); *C07K 16/2869* (2013.01); *C07K 16/2887* (2013.01); *C40B 40/08* (2013.01); *C40B 50/08* (2013.01); *C07K 2316/95* (2013.01); *C07K 2316/96* (2013.01); *C07K 2317/55* (2013.01); *C07K 2317/56* (2013.01); *C07K 2317/73* (2013.01); *C07K 2317/74* (2013.01); *C07K 2317/76* (2013.01); *C07K 2317/92* (2013.01)

(58) Field of Classification Search
None
See application file for complete search history.

(56) References Cited

U.S. PATENT DOCUMENTS

| 2003/0055006 A1 | 3/2003 | Siemeister et al. |
| 2008/0175847 A1 | 7/2008 | Yan et al. |
| 2008/0220495 A1 | 9/2008 | McCarthy et al. |
| 2008/0248028 A1 | 10/2008 | Lazar et al. |
| 2009/0246199 A1 | 10/2009 | Noguera-Troise et al. |
| 2012/0058906 A1 | 3/2012 | Smider et al. |

FOREIGN PATENT DOCUMENTS

| JP | 2010-507976 | 5/2010 |
| WO | WO 98/51799 | 5/1998 |
| WO | WO 98/45434 | 10/1998 |
| WO | WO 00/06726 | 2/2000 |
| WO | WO 03/018799 | 3/2003 |
| WO | WO 2007/070671 | 6/2007 |
| WO | WO 2007/143689 | 12/2007 |
| WO | WO 2008/019144 | 2/2008 |
| WO | WO 2008/042236 | 4/2008 |
| WO | WO2008042236 | * 4/2008 |
| WO | WO 2008/060705 | 5/2008 |
| WO | WO 2008/076379 | 6/2008 |
| WO | WO 2008/091222 | 7/2008 |
| WO | WO 2008/139202 | 11/2008 |

OTHER PUBLICATIONS

Rudikoff et al. (Proc Natl Acad Sci USA 1982 vol. 79 p. 1979).*
MacCallum et al. J. Mol. Biol. (1996) 262, 732-745.*
Pascalis et al. (The Journal of Immunology (2002) 169, 3076-3084).*
Casset et al. (BBRC 2003, 307:198-205).*
Vajdos et al. (J. Mol. Biol. (2002) 320, 415-428).*
Chen et al. (J. Mol. Bio. (1999) 293, 865-881).*
Wu et al. (J. Mol. Biol. (1999) 294, 151-162).*
Padlan et al. (PNAS 1989, 86:5938-5942).*
Lamminmaki et al. (JBC 2001, 276:36687-36694).*
Bellavia et al., "Constitutive activation of NF-kappaB and T-cell leukemia/lymphoma in Notch3 transgenic mice" EMBO J., 19:3337-3348 (2000).
Brennan and Brown, "Is there a role for Notch signalling in human breast cancer?," Breast Cancer Res., 5:69-75 (2003).
Duarte et al., "Dosage-sensitive requirement for mouse Dll4 in artery development," Genes Dev., 18:2474-2478 (2004).
Ellisen et al., "TAN-1, the human homolog of the *Drosophila* Notch gene, is broken by chromosomal translocations in T lymphoblastic neoplasms," Cell, 66:649-661 (1991).
Fung et al., "Delta-like 4 induces notch signaling in macrophages: implications for inflammation," Circulation, 115:2948-2956 (2007).
Gale et al., "Haploinsufficiency of delta-like 4 ligand results in embryonic lethality due to major defects in arterial and vascular development," PNAS, 101:15949-15954 (2004).
Gallahan and Callahan, "Mammary tumorigenesis in feral mice: identification of a new int locus in mouse mammary tumor virus (Czech II)-induced mammary tumors," J. Virol., 61:66-74 (1987).
Hallahan et al., "The SmoA1 mouse model reveals that notch signaling is critical for the growth and survival of sonic hedgehog-induced medulloblastomas," Cancer Res. 64:7794-7800 (2004).
Hoey et al., "DLL4 blockade inhibits tumor growth and reduces tumor-initiating cell frequency," Cell Stem Cell, 5:168-177 (2009).
Iso et al.,"Notch signaling in vascular development," Arterioscler. Thromb. Vasc. Biol., 23:543-553 (2003).
Iso et al., "HES and HERP families: multiple effectors of the Notch signaling pathway," J. Cell Physiol., 194:237-255 (2003).
Kopper and Hajdu, "Tumor stem cells," Pathol. Oncol. Res., 10:69-73 (2004).
Krebs et al., "Haploinsufficient lethality and formation of arteriovenous malformations in Notch pathway mutants," Genes Dev., 18:2469-2473 (2004).

(Continued)

*Primary Examiner* — Laura B Goddard
*Assistant Examiner* — Meera Natarajan
(74) *Attorney, Agent, or Firm* — Jones Day

(57) ABSTRACT

Provided herein are anti-DLL4 antibodies and methods of using anti-DLL4 antibodies as therapeutic agents in diseases or disorders associated with DLL4.

10 Claims, 4 Drawing Sheets

(56) References Cited

OTHER PUBLICATIONS

Leethanakul et al., "Distinct pattern of expression of differentiation and growth-related genes in squamous cell carcinomas of the head and neck revealed by the use of laser capture microdissection and cDNA arrays," Oncogene, 19:3220-3224 (2000).

Li and Harris, "Notch signaling from tumor cells: a new mechanism of angiogenesis," Cancer Cell, 8:1-3 (2005).

Miele and Osborne, "Arbiter of differentiation and death: Notch signaling meets apoptosis," J. Cell Physiol., 181:393-409 (1999).

Noguera-Troise et al., " Blockade of Dll4 inhibits tumour growth by promoting non-productive angiogenesis ," Nature 4P44:1032 (2006).

Parr et al., "The possible correlation of Notch-1 and Notch-2 with clinical outcome and tumour clinicopathological parameters in human breast cancer," Int. J. Mol. Med., 14:779-786 (2004).

Patel et al., "Up-regulation of delta-like 4 ligand in human tumor vasculature and the role of basal expression in endothelial cell function ," Cancer Res., 65:8690-8697 (2005).

Pear and Aster, "T cell acute lymphoblastic leukemia/lymphoma: a human cancer commonly associated with aberrant NOTCH1 signaling," Curr.Opin. Hematol., 11:416-433 (2004).

Pear et al., "Exclusive development of T cell neoplasms in mice transplanted with bone marrow expressing activated Notch alleles," J.Exp. Med., 183:2283-2291 (1996).

Politi et al., "Notch in mammary gland development and breast cancer," Semin. Cancer Biol., 14:341-347 (2004).

Purrow et al., "Expression of Notch-1 and its ligands, Delta-like-1 and Jagged-1, is critical for glioma cell survival and proliferation," Cancer Res., 65:2353-2363 (2005).

Rae et al., Novel association of a diverse range of genes with renal cell carcinoma as identified by differential display, Int. J. Cancer, 88:726-732 (2000).

Ridgway et al., "Inhibition of Dll4 signalling inhibits tumour growth by deregulating angiogenesis," Nature, 444(7122):1083-1087 (2006).

Robey et al., "An activated form of Notch influences the choice between CD4 and CD8 T cell lineages," Cell, 87:483-492 (1996).

Sainson and Harris, "Anti-Dll4 therapy: can we block tumour growth by increasing angiogenesis?," Trend Mol. Med., 13:389-395 (2007).

Suzuki et al., "Imbalanced expression of TAN-1 and human Notch4 in endometrial cancers," Int. J. Oncol., 17:1131-1139 (2000).

Thurston et al., "The Delta paradox: DLL4 blockade leads to more tumour vessels but less tumour growth," Nat. Rev. Cancer, 7:327-331 (2007).

UniProt Accession No. P46531[online], [retrieved on Jun. 10, 2015] Retrieved from the online database of UniProt using internet <URL:http://www.uniprot.org/uniprot/P46531>.

UniProt Accession No. Q99466 [online], [retrieved on Jun. 10, 2015] Retrieved from the online database of UniProt using internet <URL:http://www.uniprotorg/uniprot/Q99466>.

Van Limpt et al., "SAGE analysis of neuroblastoma reveals a high expression of the human homologue of the *Drosophila* Delta gene," Med. Pediatr. Oncol., 35:554-558 (2000).

Weijzen et al., "Activation of Notch-1 signaling maintains the neoplastic phenotype in human Ras-transformed cells," Nat. Med., 8:979-986 (2002).

Wilson and Radtke, "Multiple functions of Notch signaling in self-renewing organs and cancer," FEBS Lett., 580:2860-2868 (2006).

Yan et al., "A novel Notch ligand, Dll4, induces T-cell leukemia/lymphoma when overexpressed in mice by retroviral-mediated gene transfer ," Blood, 98:3793-3799 (2001).

Zagouras et al., "Alterations in Notch signaling in neoplastic lesions of the human cervix ," PNAS, 92:6414-6418 (1999).

* cited by examiner

Heavy Chain VH1-46_IGHD6-6*01_IGHJ1*01

| | 1 | 2 | 3 | 4 | 5 | 6 | 7 | 8 | 9 | 10 | 11 | 12 | 13 | 14 | 15 | 16 | 17 | 18 | 19 | 20 | 21 | 22 | 23 | 24 | 25 |
|---|---|---|---|---|---|---|---|---|---|---|---|---|---|---|---|---|---|---|---|---|---|---|---|---|---|
| FW1 | Q | V | Q | L | V | Q | S | G | A | E | V | K | K | P | G | A | S | V | K | V | S | C | K | A | S |
| Kabat | 1 | 2 | 3 | 4 | 5 | 6 | 7 | 8 | 9 | 10 | 11 | 12 | 13 | 14 | 15 | 16 | 17 | 18 | 19 | 20 | 21 | 22 | 23 | 24 | 25 |
| Chothia | 1 | 2 | 3 | 4 | 5 | 6 | 7 | 8 | 9 | 10 | 11 | 12 | 13 | 14 | 15 | 16 | 17 | 18 | 19 | 20 | 21 | 22 | 23 | 24 | 25 |

| | 26 | 27 | 28 | 29 | 30 | 31 | 32 | 33 | 34 | 35 |
|---|---|---|---|---|---|---|---|---|---|---|
| CDRH1 | G | Y | T | F | T | S | Y | Y | M | H |
| Kabat | 26 | 27 | 28 | 29 | 30 | 31 | 32 | 33 | 34 | 35 |
| Chothia | 26 | 27 | 28 | 29 | 30 | 31 | 32 | 33 | 34 | 35 |

| | 36 | 37 | 38 | 39 | 40 | 41 | 42 | 43 | 44 | 45 | 46 | 47 | 48 | 49 |
|---|---|---|---|---|---|---|---|---|---|---|---|---|---|---|
| FW2 | W | V | R | Q | A | P | G | Q | G | L | E | W | M | G |
| Kabat | 36 | 37 | 38 | 39 | 40 | 41 | 42 | 43 | 44 | 45 | 46 | 47 | 48 | 49 |
| Chothia | 36 | 37 | 38 | 39 | 40 | 41 | 42 | 43 | 44 | 45 | 46 | 47 | 48 | 49 |

| | 50 | 51 | 52 | 53 | 54 | 55 | 56 | 57 | 58 | 59 | 60 | 61 | 62 | 63 | 64 | 65 | 66 |
|---|---|---|---|---|---|---|---|---|---|---|---|---|---|---|---|---|---|
| CDRH2 | I | I | N | P | S | G | G | S | T | S | Y | A | Q | K | F | Q | G |
| Kabat | 50 | 51 | 52 | 52a | 53 | 54 | 55 | 56 | 57 | 58 | 59 | 60 | 61 | 62 | 63 | 64 | 65 |
| Chothia | 50 | 51 | 52 | 52a | 53 | 54 | 55 | 56 | 57 | 58 | 59 | 60 | 61 | 62 | 63 | 64 | 65 |

| | 67 | 68 | 69 | 70 | 71 | 72 | 73 | 74 | 75 | 76 | 77 | 78 | 79 | 80 | 81 | 82 | 83 | 84 | 85 | 86 | 87 | 88 | 89 | 90 | 91 | 92 | 93 | 94 |
|---|---|---|---|---|---|---|---|---|---|---|---|---|---|---|---|---|---|---|---|---|---|---|---|---|---|---|---|---|
| FW3 | R | V | T | M | T | R | D | T | S | T | S | T | V | Y | M | E | L | S | S | L | R | S | E | D | T | A | V | Y |
| Kabat | 66 | 67 | 68 | 69 | 70 | 71 | 72 | 73 | 74 | 75 | 76 | 77 | 78 | 79 | 80 | 81 | 82 | 82a | 82b | 82c | 83 | 84 | 85 | 86 | 87 | 88 | 89 | 90 |
| Chothia | 66 | 67 | 68 | 69 | 70 | 71 | 72 | 73 | 74 | 75 | 76 | 77 | 78 | 79 | 80 | 81 | 82 | 82a | 82b | 82c | 83 | 84 | 85 | 86 | 87 | 88 | 89 | 90 |

| | 95 | 96 | 97 | 98 | 99 | 100 | 101 | 102 | 103 | 104 | 105 | 106 | 107 | 108 | 109 | 110 | 111 |
|---|---|---|---|---|---|---|---|---|---|---|---|---|---|---|---|---|---|
| CDRH3 | Y | C | A | R | E | Y | S | S | S | S | A | E | Y | F | Q | H | |
| Kabat | 91 | 92 | 93 | 94 | 95 | 96 | 97 | 98 | 99 | 100 | 100a | 100b | 100c | 100d | 100e | 101 | 102 |
| Chothia | 91 | 92 | 93 | 94 | 95 | 96 | 97 | 98 | 99 | 100 | 100a | 100b | 100c | 100d | 100e | 101 | 102 |

| | 112 | 113 | 114 | 115 | 116 | 117 | 118 | 119 | 120 | 121 | 122 | 123 | 124 |
|---|---|---|---|---|---|---|---|---|---|---|---|---|---|
| FW4 | W | G | Q | G | T | L | V | T | V | S | S | A | S |
| Kabat | 103 | 104 | 105 | 106 | 107 | 108 | 109 | 110 | 111 | 112 | 113 | | |
| Chothia | 103 | 104 | 105 | 106 | 107 | 108 | 109 | 110 | 111 | 112 | 113 | | |

FIGURE 1A

Light Chain L6_IGKJ1*01

| | 1 | 2 | 3 | 4 | 5 | 6 | 7 | 8 | 9 | 10 | 11 | 12 | 13 | 14 | 15 | 16 | 17 | 18 | 19 | 20 | 21 | 22 | 23 |
|---|---|---|---|---|---|---|---|---|---|---|---|---|---|---|---|---|---|---|---|---|---|---|---|
| FW1 | E | I | V | L | T | Q | S | P | A | T | L | S | L | S | P | G | E | R | A | T | L | S | C |
| Kabat | 1 | 2 | 3 | 4 | 5 | 6 | 7 | 8 | 9 | 10 | 11 | 12 | 13 | 14 | 15 | 16 | 17 | 18 | 19 | 20 | 21 | 22 | 23 |
| Chothia | 1 | 2 | 3 | 4 | 5 | 6 | 7 | 8 | 9 | 10 | 11 | 12 | 13 | 14 | 15 | 16 | 17 | 18 | 19 | 20 | 21 | 22 | 23 |

| | 24 | 25 | 26 | 27 | 28 | 29 | 30 | 31 | 32 | 33 | 34 |
|---|---|---|---|---|---|---|---|---|---|---|---|
| CDRL1 | R | A | S | Q | S | V | S | Y | L | A |
| Kabat | 24 | 25 | 26 | 27 | 28 | 29 | 30 | 31 | 32 | 33 | 34 |
| Chothia | 24 | 25 | 26 | 27 | 28 | 29 | 30 | 31 | 32 | 33 | 34 |

| | 35 | 36 | 37 | 38 | 39 | 40 | 41 | 42 | 43 | 44 | 45 | 46 | 47 | 48 | 49 |
|---|---|---|---|---|---|---|---|---|---|---|---|---|---|---|---|
| FW2 | W | Y | Q | Q | K | P | G | Q | A | P | R | L | L | I | Y |
| Kabat | 35 | 36 | 37 | 38 | 39 | 40 | 41 | 42 | 43 | 44 | 45 | 46 | 47 | 48 | 49 |
| Chothia | 35 | 36 | 37 | 38 | 39 | 40 | 41 | 42 | 43 | 44 | 45 | 46 | 47 | 48 | 49 |

| | 50 | 51 | 52 | 53 | 54 | 55 | 56 |
|---|---|---|---|---|---|---|---|
| CDRL2 | D | A | S | N | R | A | T |
| Kabat | 50 | 51 | 52 | 53 | 54 | 55 | 56 |
| Chothia | 50 | 51 | 52 | 53 | 54 | 55 | 56 |

| | 57 | 58 | 59 | 60 | 61 | 62 | 63 | 64 | 65 | 66 | 67 | 68 | 69 | 70 | 71 | 72 | 73 | 74 | 75 | 76 | 77 | 78 | 79 | 80 | 81 | 82 | 83 | 84 | 85 | 86 | 87 | 88 |
|---|---|---|---|---|---|---|---|---|---|---|---|---|---|---|---|---|---|---|---|---|---|---|---|---|---|---|---|---|---|---|---|---|
| FW3 | G | I | P | A | R | F | S | G | S | G | S | G | T | D | F | T | L | T | I | S | S | L | E | P | E | D | F | A | V | Y | Y | C |
| Kabat | 57 | 58 | 59 | 60 | 61 | 62 | 63 | 64 | 65 | 66 | 67 | 68 | 69 | 70 | 71 | 72 | 73 | 74 | 75 | 76 | 77 | 78 | 79 | 80 | 81 | 82 | 83 | 84 | 85 | 86 | 87 | 88 |
| Chothia | 57 | 58 | 59 | 60 | 61 | 62 | 63 | 64 | 65 | 66 | 67 | 68 | 69 | 70 | 71 | 72 | 73 | 74 | 75 | 76 | 77 | 78 | 79 | 80 | 81 | 82 | 83 | 84 | 85 | 86 | 87 | 88 |

| | 89 | 90 | 91 | 92 | 93 | 94 | 95 | 96 | 96a | 97 | 98 |
|---|---|---|---|---|---|---|---|---|---|---|---|
| CDRL3 | Q | Q | R | S | N | W | P | P | a | W | T |
| Kabat | 89 | 90 | 91 | 92 | 93 | 94 | 95 | 96 | a | 97 |
| Chothia | 89 | 90 | 91 | 92 | 93 | 94 | 95 | 96 | a | 97 |

| | 99 | 100 | 101 | 102 | 103 | 104 | 105 | 106 | 107 | 108 | 109 | 110 |
|---|---|---|---|---|---|---|---|---|---|---|---|---|
| FW4 | F | G | Q | G | T | K | V | E | I | K | R | T |
| Kabat | 98 | 99 | 100 | 101 | 102 | 103 | 104 | 105 | 106 | 107 | 108 | 109 |
| Chothia | 98 | 99 | 100 | 101 | 102 | 103 | 104 | 105 | 106 | 107 | 108 | 109 |

FIGURE 1B

**Heavy Chain VH5-51_IGHD5-18*01>3_IGHJ4*01**

```
FW1
           1  2  3  4  5  6  7  8  9  10 11 12 13 14 15 16 17 18 19 20 21 22 23 24 25
           E  V  Q  L  V  Q  S  G  A  E  V  K  K  P  G  E  S  L  K  I  S  C  K  G  S
Kabat      1  2  3  4  5  6  7  8  9  10 11 12 13 14 15 16 17 18 19 20 21 22 23 24 25
Chothia    1  2  3  4  5  6  7  8  9  10 11 12 13 14 15 16 17 18 19 20 21 22 23 24 25

CDRH1
           26 27 28 29 30 31 32 33 34 35
           G  Y  S  F  T  S  Y  W  I  G
Kabat      26 27 28 29 30 31 32 33 34 35
Chothia    26 27 28 29 30 31 32 33 34

FW2
           36 37 38 39 40 41 42 43 44 45 46 47 48 49
           W  V  R  Q  M  P  G  K  G  L  E  W  M  G
Kabat      36 37 38 39 40 41 42 43 44 45 46 47 48 49
Chothia    36 37 38 39 40 41 42 43 44 45 46 47 48 49

CDRH2
           50 51 52 53 a  54 55 56 57 58 59 60 61 62 63 64 65 66
           I  H  Y  P     G  D  S  D  T  R  Y  S  P  S  F  Q  G
Kabat      50 51 52 53 a  54 55 56 57 58 59 60 61 62 63 64 65 66
Chothia    50 51 52 a     53 54 55 56 57 58 59 60 61 62 63 64 65

FW3
           67 68 69 70 71 72 73 74 75 76 77 78 79 80 81 82 83 84 85 86 87 88 89 90 91 92 93 94
           Q  V  T  I  S  A  D  K  S  I  S  T  A  Y  L  Q  W  S  S  L  K  A  S  D  T  A  M  Y  Y  C  A  R
Kabat      67 68 69 70 71 72 73 74 75 76 77 78 79 80 81 82 a  b  c  83 84 85 86 87 88 89 90 91 92 93 94
Chothia    66 67 68 69 70 71 72 73 74 75 76 77 78 79 80 81 82 a  b  c  83 84 85 86 87 88 89 90 91 92 93 94

CDRH3
           99 100 101 102 103 104 105 106 107 108 109 110
           R  G  Y   S   Y   G   Y   D   Y   F   D   Y
Kabat      95 96  97  98  99  100 101 102 d   c   d   101 102
Chothia    95 96  97  98  99  100 101 102 d   c   d   101 102

FW4
           111 112 113 114 115 116 117 118 119 120 121 122 123
           W   G   Q   G   T   L   V   T   V   S   S   A   S
Kabat      103 104 105 106 107 108 109 110 111 112 113
Chothia    103 104 105 106 107 108 109 110 111 112 113
```

FIGURE 2A

Light Chain V3-4_IGLJ1*01

```
          1   2   3   4   5   6   7   8   9  10   -  11  12  13  14  15  16  17  18  19  20  21  22
          Q   T   V   V   T   Q   E   P   S   F       S   V   S   P   G   G   T   V   T   L   T   C
FW1
Kabat     1   2   3   4   5   6   7   8   9  10      11  12  13  14  15  16  17  18  19  20  21  22  23
Chothia   1   2   3   4   5   6   7   8   9  10      11  12  13  14  15  16  17  18  19  20  21  22  23

23  24  25  26  27  28  29  30  31  32  33  34  35
          G   L   S   S   G   S   V   S   T   S   Y   Y   P
CDRL1
Kabat    24  25  26  27  28  29  30  31  32  33  34
Chothia  24  25  26  27  28  29  30   a   b   c  31  32  33

36  37  38  39  40  41  42  43  44  45  46  47  48  49  50  51
          S   W   Y   Q   Q   T   P   G   Q   A   P   R   T   L   I   Y
FW2
Kabat    34  35  36  37  38  39  40  41  42  43  44  45  46  47  48  49
Chothia  34  35  36  37  38  39  40  41  42  43  44  45  46  47  48  49

52  53  54  55  56  57  58
          S   T   N   T   R   S   S
CDRL2
Kabat    50  51  52  53  54  55  56
Chothia  50  51  52  53  54  55  56

59  60  61  62  63  64  65  66  67  68  69  70  71  72  73  74  75  76  77  78  79  80  81  82  83  84  85  86  87  88  89  90
          G   V   P   D   R   F   S   G   S   I   L   G   N   K   A   A   L   T   I   T   G   A   Q   A   D   D   E   S   D   Y   Y   C
FW3
Kabat    57  58  59  60  61  62  63  64  65  66  67  68  69  70  71  72  73  74  75  76  77  78  79  80  81  82  83  84  85  86  87  88
Chothia  57  58  59  60  61  62  63  64  65  66  67  68  69  70  71  72  73  74  75  76  77  78  79  80  81  82  83  84  85  86  87  88

91  92  93  94  95  96  97  98  99 100 101
          V   L   Y   M   G   S   G   I   S   Y   V
CDRL3
Kabat    89  90  91  92  93  94  95   a   b   b  96  97
Chothia  89  90  91  92  93  94  95   a   a           96  97

101 102 103 104 105 106 107 108 109 110
          F   G   T   G   T   K   V   T   V   L
FW4
Kabat    98  99 100 101 102 103 104 105 106   a
Chothia  98  99 100 101 102 103 104 105 106   a
```

ANTI-DLL4 ANTIBODIES AND USES THEREOF

RELATED APPLICATIONS

Benefit of priority is claimed to U.S. Provisional Application Ser. No. 61/198,764, entitled "Combinatorial Antibody Libraries and Uses Thereof," filed Nov. 7, 2008, and to U.S. Provisional Application Ser. No. 61/211,204, entitled "Combinatorial Antibody Libraries and Uses Thereof," filed Mar. 25, 2009. Where permitted, the subject matter of the above-noted applications is incorporated by reference in its entirety.

This application also is related to International PCT Application No. PCT/US09/63299, entitled "Combinatorial Antibody Libraries and Uses Thereof," filed Nov. 4, 2009, which claims priority to U.S. Provisional Application No. 61/198,764 and to U.S. Provisional Application No. 61/211,204.

This application also is related to U.S. Provisional Application No. 61/280,618, entitled "Methods for Affinity-Maturation-Based Antibody Optimization," filed Nov. 9, 2009.

Where permitted, the subject matter of each of the above-noted related applications is incorporated by reference in its entirety.

INCORPORATION BY REFERENCE OF SEQUENCE LISTING PROVIDED ELECTRONICALLY

The instant application contains a Sequence Listing that has been submitted via EFS-Web and is hereby incorporated by reference in its entirety. Said ASCII copy, created on Jul. 15, 2011, is named FAB0703US.txt, and is 842,514 bytes in size.

FIELD OF THE INVENTION

Provided herein are anti-DLL4 antibodies and methods of using anti-DLL4 antibodies as therapeutic agents in diseases or disorders associated with DLL4.

BACKGROUND

Development of a vascular supply is a fundamental requirement for many physiological and pathological processes. For example, the process of angiogenesis, which promotes new blood vessel formation, ensures that actively growing tissues get an adequate blood supply. Angiogenesis, however, also is implicated in the pathogenesis of a variety of disorders. The process of vascular development, including endothelial cell differentiation, proliferation and migration is tightly regulated. For example, members of the Notch-signaling pathway play a role in regulating processes such as cell fate determination, cellular differentiation, proliferation, survival and apoptosis, including in the vascular endothelium. The Notch ligand, Delta-like 4 (DLL4), exhibits highly selective expression in the vascular endothelium. Notch signaling also is involved in a wide variety of human diseases. Thus, there is a need to develop agents that can be used as therapeutics to to regulate Notch signaling.

SUMMARY

Provided herein are anti-DLL4 antibodies or antigen-binding fragments thereof that specifically bind to human DLL4. Anti-DLL4 antibodies include antibodies that have at least one complementary determining region (CDR) that is a CDRH1, a CDRH2, a CDRH3, a CDRL1, a CDRL2 or a CDRL3. For example, the antibody can contain a heavy chain CDR3 (CDRH3) that has a sequence of amino acids set forth as EEYSSSSAEYFQH (SEQ ID NO:851); RGYSYGYDYFDY (SEQ ID NO:852); EYYDFWSGYYTDYFDY (SEQ ID NO:853); EGYSSSWYDYFDY (SEQ ID NO:854); ANWGDYFDY (SEQ ID NO:855); DDYGGNSDYFDY (SEQ ID NO:8569); EGYCSGGSCYS (SEQ ID NO:857); EYYYGSGSYYNDYFDY (SEQ ID NO:858); GCYCSSTSCYADYYYYYGMDV (SEQ ID NO:859); GSCYSYWYFDL (SEQ ID NO:860); or a sequence of amino acids that exhibits at least 65% sequence identity to the sequence of amino acids set forth in any of SEQ ID NOS: 851-860. The antibody can contain a heavy chain CDR2 (CDRH2) that has a sequence of amino acids set forth as IINPSGGSTSYAQKFQG (SEQ ID NO:844); IIYPGDSDTRYSPSFQG (SEQ ID NO:845); RTYYRSKWYNDYAVSVKS (SEQ ID NO:846); EINHSGSTNYNPSLKS (SEQ ID NO:847); INSNAGNGNTKYSQEFQG (SEQ ID NO: 848); WMNPNSGNTGYAQKFQG (SEQ ID NO:849); YIYYSGSTYYNPSLKS (SEQ ID NO:850); or a sequence of amino acids that exhibits at least 65% sequence identity to the sequence of amino acids set forth in any of SEQ ID NOS: 844-850. The antibody can contain a heavy chain CDR1 (CDRH1) that has a sequence of amino acids set forth as GYTFTSYYMH (SEQ ID NO: 830); GYSFTSYWIG (SEQ ID NO:831); GDSVSSNSAA (SEQ ID NO:832); GGSFSGYYWS (SEQ ID NO:833); GYTFTSYAMH (SEQ ID NO:834); GYTFTSYAIN (SEQ ID NO:835); GGSISSGGYY (SEQ ID NO:836); or a sequence of amino acids that exhibits at least 65% sequence identity to a sequence of amino acids set forth in any of SEQ ID NOS: 831-836, with the proviso that the sequence of amino acids is not GYTFTSYVIN (SEQ ID NO:904); and a sequence of amino acids that exhibits at least 72% sequence identity to the sequence of amino acids set forth in SEQ ID NO:830. The antibody can contain a light chain CDR3 (CDRL3) that has a sequence of amino acids set forth as QQRSNWPPWT (SEQ ID NO:881); VLYMGSGISYV (SEQ ID NO:882); MIWHSSASFV (SEQ ID NO: 883); QQYNNWPPWT (SEQ ID NO: 884); QANSFPPWT (SEQ ID NO:885); QQYGSSPPWT (SEQ ID NO: 886); QQYNSYSPWT (SEQ ID NO:887); MQRIEFPSWT (SEQ ID NO: 888); SSYTSSSTLFV (SEQ ID NO: 889); and QVYESSANFV (SEQ ID NO: 890); and a sequence of amino acids that exhibits at least 65% sequence identity to the sequence of amino acids set forth in any of SEQ ID NOS: 881-890. The antibody can contain a light chain CDR2 (CDRL2) is selected from among a CDRL2 having a sequence of amino acids set forth as DASNRAT (SEQ ID NO:871); STNTRSS (SEQ ID NO: 872); YYSDSSK (SEQ ID NO:873); GASTRAT (SEQ ID NO:874); AASSLQS (SEQ ID NO:875); GASSRAT (SEQ ID NO:876); DASSLGS (SEQ ID NO:877); TLSYRAS (SEQ ID NO:878); EVSNRPS (SEQ IDNO:879); HYSDSDK (SEQ ID NO:880); or a sequence of amino acids that exhibits at least 65% sequence identity to the sequence of amino acids set forth in any of SEQ ID NOS: 871-880. The antibody can contain a light chain CDR1 (CDRL1) that has a sequence of amino acids set forth as RASQSVSSYLA (SEQ ID NO: 861); GLSSGSVSTSYYPS (SEQ ID NO:862); TLRSGINLGSYRIF (SEQ ID NO:863); RASQSVSSNLA (SEQ ID NO:864); RASQGISSWLA (SEQ ID NO:865); RASQVSSSYLA (SEQ ID NO:866); RASQSISSWLA (SEQ ID NO:867); RSSQSLLDSDDGNTYLD (SEQ ID NO:868); TGTSSDVGGTNYVS (SEQ ID NO:869); TLSSDLSVGGKNMF (SEQ ID NO:870); or a sequence of amino acids that exhibits at least 65% sequence identity to the sequence of amino acids set forth in any of SEQ ID NOS:

861-870. The antibodies provided herein can contain 2, 3, 4, 5 or 6 different CDRs that is a CDRH1, CDRH2, CDRH3, CDRL1, CDRL2 or CDRL3.

The antibodies provided herein include those are are a full-length antibody or an antibody fragment. For example, the antibody fragment can be a Fab, Fab', F(ab')$_2$, single-chain Fvs (scFv), Fv, dsFv, diabody, Fd and Fd' fragments, Fab fragments, Fd fragments, scFv fragments, or a scFab fragments. Generally, the antibody is a a Fab or is a full-length IgG.

The antibodies provided herein include antibodies where the CDR set forth in any of SEQ ID NOS: 830-836 and 844-890 is modified by amino acid replacement, addition or deletion. In any of the antibodies provided herein, the CDR (e.g. a CDRH1, CDRH2, CDRH3, CDRL1, CDRL2, or CDRL3) exhibits 70%, 75%, 80%, 85%, 90%, 91%, 92%, 93%, 94%, 95%, 96%, 97%, 98% or 99% sequence identity to the sequence of amino acids set forth in any of SEQ ID NOS: 830-836 and 844-890.

In one example, an anti-DLL4 provided herein contains modification of a CDRH1 set forth in SEQ ID NO: 830 that has one or more amino acid replacement(s) at positions T28, F29, T30, S31 and Y33, based on kabat numbering. For example, the antibody can have one or more amino acid replacement(s) that is T28A, F29A, T30A, S31A and/or Y33A.

In another example, an anti-DLL4 antibody provided herein contains modification of a CDRH1 set forth in SEQ ID NO:831 that has one or more amino acid replacement(s) at positions S28, F29, T30, W33, I34 and G35, based on kabat numbering. For example, the antibody can have one or more amino acid replacement(s) that is S28A, S28R, S28K, S28N, F29A, T30A, W33A, I34A, G35T, G35A and/or G35V.

In an additional example, an anti-DLL4 antibody provided herein contains modification of a CDRH2 set forth in SEQ ID NO: 844 that has one or more amino acid replacement(s) at positions I50, I51, N52, P52a, S53, G54, G55, G56, T57 and S58, based on kabat numbering. For example, the one or more amino acid replacement(s) can be I50A, I50T, I51A, I51T, I51V, I51N, I51R, I51W, I51S, I51G, I51V, I51E, I51H, I51Y, N52A, N52V, N52G, N52T, N52P, N52L, N52W, N52Y, N52V, N52S, N52Q, N52K, P52aA, P52aM, P52aE, P52aH, P52aY, P52aT, P52aN, P52aR, P52aW, P52aS, P52aG, S53A, S53I, S53E, S53R, S53G, S53T, S53L, S53V, S53N, S53P, G54A, G54W, G54D, G55A, G55V, G55E, G55S, G55K, G55T, G55L, G55R, G55H, G55I, G55W, S58A, T57A and/or S58A. In particular, an antibody provided herein contains amino acid replacement(s) I51V/N52L/S53T/G55H, N52L/S53T/G55H, I51E/N52L/S53T/G55H or I51N/N52L/S53T/G55H.

In a further example, an anti-DLL4 antibody provided herein contains modification of a CDRH2 set forth in SEQ ID NO:845 that has one or more amino acid replacement(s) at positions I50, I51, Y52, P52a, D54, S55, D56 and/or T57, based on kabat numbering. The one or more amino acid replacement(s) can be I50A, I51A, Y52A, P52aA, D54A, S55G, D56A, T57D and/or T57A.

In another example, an anti-DLL4 antibody provided herein contains a modification of a CDRH3 set forth in SEQ ID NO:851 that has one or more amino acid replacement(s) at positions E96, Y97, S98, S99, S100, S100a, A100b, E100c, Q101 and/or H102, based on kabat numbering. The one or more amino acid replacement(s) can be E96A, Y97A, S98A, S98Q, S98V, S98I, S98G, S99P, S99A, S99L, S99W, S99F, S99N, S99H, S99C, S99G, S100F, S100A, S100G, S100C, S100H, S100L, S100R, S100aA, A100bE, E100cA, Q101A, H102A, H102S, H102F and/or H102Y. In particular, the amino acid replacement(s) is S98A/S99P/S100F, S98A/S99P/S100F/H102F or S98A/S99P/S100F/H102Y.

In an example of an anti-DLL4 antibody provided herein, the antibody contains a modification of a CDRH3 set forth in SEQ ID NO: 852 that has one or more amino acid replacement(s) at positions R95, G96, Y97, S98, Y99, G100, Y100a, D100b, and/or D101, based on kabat numbering. The one or more amino acid replacement(s) is selected from among R95A, G96K, G96R, G96L, G96D, G96T, Y97A, Y97H, S98A, Y99A, G100A, G100D, G100L, G100P, G100R, G100M, G100K, G100S, G100R, G100T, Y100aA, D100bA and/or D101A. In particular, the amino acid replacement(s) is G96K/G100T.

In another example, the antibody contains a modification of a CDRL1 set forth in SEQ ID NO:861 that has one or more amino acid replacement(s) at positions R24, Q27, S28, S30, S31 and/or Y32, based on kabat numbering. The one or more amino acid replacement(s) is selected from among R24G, Q27L, S28P, S28G, S28K, S28V, S28F, S28P, S28T, S28L, S28Q, S28A, S28N, S28H, S28I, S28R, S28W, S28M, S28E, S30N, S30W, S30R, S30L, S30C, S30D, S30L, S30T, S30P, S30Y, S30Q, S30A, S30G, S30V, S31K, S31T, S31N, S31K, S31L, S31M, S31F, S31I, S31V, S31H, S31A, S31P, S31D, S31R, S31Y, S31Q, S31E, S31G, Y32V and/or Y32S. In particular, the antibody has the amino acid replacement(s) is S28N/S30D/S31H.

In an additional example, an anti-DLL4 antibody provided herein contains a modification of a CDRL1 set forth in SEQ ID NO:862 that has one or more amino acid replacement(s) at positions G24, L25, S26, S27, G27a, S27b, V27c, S28, T29, S30, Y31, Y32, P33, based on kabat numbering. The one or more amino acid replacement(s) are selected from among G24A, G24R, G24L, L25A, S26A, S27A, G27aA, S27bA, V27cA, S28A, T29A, S30A, Y31A, Y32A and/or P33A.

In a further example, an anti-DLL4 antibody provided herein contains a modification of a CDRL2 set forth in SEQ ID NO:871 that has one or more amino acid replacement(s) at positions D50, A51, S52, N53, R54, A55 and/or T56, based on kabat numbering. The one or more amino acid replacement(s) are selected from among D50A, A51T, S52A, S52L, S52T, S52R, S52S, S52W, S52N, S52P, S52M, N53A, N53E, N53G, N53M, N53C, N53H, N53P, R54A, A55T, A55R, A55C, A55S, A55G and T56A. In particular, the amino acid replacement(s) are S52L/A55S or S52L/A55G.

In an example of an anti-DLL4 antibody provided herein, the antibody contains a modification of a CDRL2 set forth in SEQ ID NO:872 that has one or more amino acid replacement(s) at positions S50, T51, N52, T53, R54, S55 and/or S56, based on kabat numbering. The one or more amino acid replacement(s) are selected from among S50A, S50F, S50G, S50C, S50R, S50L, S50M, S50V, S50P, S50T, S50H, S50Q, S50N, S50K, S50D, S50E, S50W, T51A, T51F, T51L, T51I, T51M, T51V, T51S, T51P, T51Y, T51H, T51Q, T51N, T51K, T51D, T51E, T51W, T51R, T51G, N52A, T53A, R54A, R54I, R54Y, R54D, R54G, S55A, S55F, S55L, S55I, S55M, S55V, S55P, S55T, S55Y, S55H, S55Q, S55N, S55K, S55D, S55E, S55W, S55R, S55G and/or S56A.

In an additional example, an anti-DLL4 antibody provided herein contains a modification of a CDRL3 set forth in SEQ ID NO:881 that has one or more amino acid replacement(s) at positions R91, S92, N93 and/or W94, based on kabat numbering. The one or more amino acid replacements are selected from among R91P, R91L, R91G, S92P, S92A, S92Q, S92V, S92T, S92R, S92G, S92V, S92M, S92N, S92C, N93Y, N93S, N93H, N93Q, W94R, W94S, W94T, W94L, W94P and W94M.

In a further example, an anti-DLL4 antibody provided herein contains a modification of a CDRL3 set forth in SEQ ID NO:882 that has one or more amino acid replacement(s) at positions V89, L90, Y91, M92, G93, S94, G95, I95a and/or S95b, based on kabat numbering. The one or more amino acid replacement(s) are selected from among V89A, V89P, V89T, V89S, V89L, V89R, V89C, V89E, V89W, V89N, V89I, V89G, V89H, L90A, Y91A, M92A, M92E, M92S, M92G, M92L, M92P, M92V, M92D, M92R, M92N, M92T, M92F, G93A, S94A, S94W, S94G, S94P, S94R, S94L, S94M, S94E, S94V, G94A, I95aA and/or S95bA. In particular, the amino acid replacement(s) are M92R/S94M or V89L/S94P.

In any of the above antibodies provided herein, the antibody can contain at least two CDRs selected from among any of the CDRH3; a CDRH2; a CDRH1; a CDRL3; a CDRL2; and a CDRL1. For example, the antibody can contain a variable heavy chain containing at least one CDR that is any of the provided CDRH3; a CDRH2; a CDRH1; and a variable light chain containing at least one CDR that is any of the provided CDRL3; a CDRL2; and a CDRL1. In another example, antibodies provided herein can contain a variable heavy chain containing at least two CDRs that is any of the provided CDRH3; a CDRH2; a CDRH1; and a variable light chain containing at least one CDR that is a CDRL3; a CDRL2; and a CDRL1. In a further example, an anti-DLL4 antibody provided herein contains a variable heavy chain containing at least two CDRs that is any of the provide CDRH3; a CDRH2; a CDRH1; and contains a variable light chain containing at least two CDRs that is any of the provided CDRL3; a CDRL2; and a CDRL1.

Included among anti-DLL4 antibodies provided herein is an antibody that contains a CDRH2 set forth in SEQ ID NO: 844 that contains an amino acid replacement G55H; and a CDRH3 set forth in SEQ ID NO:851 that contains an amino acid replacement S98A/S99P/S100F/H102F. In another example, an anti-DLL4 antibody provided herein contains a CDRH3 set forth in SEQ ID NO:851 that contains an amino acid replacement S98A/S99P/S100F/H102F; and a CDRL1 set forth in SEQ ID NO: 861 that contains an amino acid replacement S28N/S30D/S31H. In a further example, an anti-DLL4 antibody provided herein contains a CDRH2 set forth in SEQ ID NO:844 that contains an amino acid replacement I51V/N52L/S53T/G55H; a CDRH3 set forth in SEQ ID NO:851 that contains an amino acid replacement S98A/S99P/S100F/H102F; and a CDRL1 set forth in SEQ ID NO: 861 that contains an amino acid replacement S28N/S30D/S31H. In an additional example, an anti-DLL4 antibody provided herein contains a CDRH2 set forth in SEQ ID NO:844 that contains an amino acid replacement I51V/N52L/S53T/G55H; a CDRH3 set forth in SEQ ID NO:851 that contains an amino acid replacement S98A/S99P/S100F/H102F; a CDRL1 set forth in SEQ ID NO: 861 that contains an amino acid replacement S28N/S30D/S31H; and a CDRL2 set forth in SEQ ID NO:871 that contains an amino acid replacement S52L/A55S.

Further included among anti-DLL4 antibodies provided here is an antibody that contains a CDRH1 set forth in SEQ ID NO:831 that contains an amino acid replacement S28R/G35V; a CDRH3 set forth in SEQ ID NO:852 that contains an amino acid replacement G96K/G100T; and a CDRL3 set forth in SEQ ID NO:882 that contains an amino acid replacement M92R/S94M. In another example, an anti-DLL4 antibody provided herein contains a CDRH1 set forth in SEQ ID NO:831 that contains an amino acid replacement S28R/G35V; a CDRH3 set forth in SEQ ID NO:852 that contains an amino acid replacement G96K/G100T; and a CDRL3 set forth in SEQ ID NO:882 that contains an amino acid replacement V89L/S94P. In an additional example, an anti-DLL4 antibody provided herein contains a CDRH1 set forth in SEQ ID NO:831 that contains an amino acid replacement S28R/G35V; a CDRH3 set forth in SEQ ID NO:852 that contains an amino acid replacement G96K/G100T; a CDRL2 set forth in SEQ ID NO:872 that contains an amino acid replacement S50G; and a CDRL3 set forth in SEQ ID NO:882 that contains an amino acid replacement V89L/S94P.

In any of the above anti-DLL4 antibodies provided herein, the antibody can further contain one or more amino acid replacements in a framework region of the antibody. For example, the antibody can have 1, 2, 3, 4, 5, 6, 7, 8, 9, 10 or more amino acid replacements in a framework region of the antibody. In one example, the variable light chain an anti-DLL4 antibody provided herein includes one or more amino acid replacements and the amino acid replacement is at position 62 or 76, based on kabat numbering. The amino acid replacement(s) can be amino acid replacements F62L, S76E, S76Q, S76P, S76L, S76T, S76G, S76A, S76Y, S76N, T76S, T76E, T76Y and/or T76M. In another example, the variable heavy chain of an anti-DLL4 antibody provided herein includes one or more amino acid replacements at amino acid position 24 and/or 82a, based on kabat numbering. For example, the amino acid replacement(s) can be G24T, G24L G24A, and/or S82aT.

The anti-DLL4 antibodies provided herein exhibit at least a binding affinity that is $10^{-6}$ M, $10^{-7}$ M, $10^{-8}$ M, $10^{-9}$ M, $10^{-10}$ M, $10^{-11}$ M or $10^{-12}$ M or lower as measured by surface plasmon resonance (SPR).

The anti-DLL4 antibodies provided herein include antibodies that are germline-derived or a modified form thereof. For example, an antibody provided herein includes a VH chain encoded by a sequence of nucleotides compiled from a $V_H$, $D_H$ and $J_H$ germline segment or modified germline segments thereof where the $V_H$ germline segment is an IGHV1, an IGHV4, an IGHV5 or an IGHV6 or genes and alleles thereof; the $D_H$ germline segment is an IGHD6, an IGHD5, an IGHD4, an IGHD2, an IGHD3, or an IGHD7 or genes and alleles thereof; and the $J_H$ germline segment is an IGHJ1, an IGHJ2, an IGHJ4, or an IGHJ6 or genes and alleles thereof. Antibodies provided herein also include those having a VL chain encoded by a sequence of nucleotides compiled from a $V_\kappa$ and $J_\kappa$ or $V_\lambda$ and $J_\lambda$ germline segments where the $V_\kappa$ germline segment is an IGKV1, an IGKV2, or an IGKV3 and the Jκ is a IGKJ1 or genes and alleles thereof; or the $V_\lambda$ germline segment is an IGLV2, an IGLV8, an IGLV11 or an IGLV5 and the $J_\lambda$ germline segment is a IGLJ1 or a IGLJ4 or genes and alleles thereof, wherein the antibody binds DLL4 and/or modulates an activity of DLL4.

For example, anti-DLL4 antibodies provided herein include those that have a $V_H$ germline segment that is an IGHV1-3*01, an IGHV1-3*02, an IGHV1-8*01, an IGHV1-46*01, an IGHV1-46*02, an IGHV1-46*03, an IGHV4-31*01, an IGHV4-31*02, an IGHV4-31*03, an IGHV4-31*04, an IGHV4-31*05, an IGHV4-31*06, an IGHV4-31*07, an IGHV4-31*08, an IGHV4-31*09, an IGHV4-31*10, an IGHV4-34*01, an IGHV4-34*02, an IGHV4-34*03, an IGHV4-34*04, an IGHV4-34*05, an IGHV4-34*06, an IGHV4-34*07, an IGHV4-34*08, an IGHV4-34*09, an IGHV4-34*10, an IGHV4-34*11, an IGHV4-34*12, an IGHV4-34*13, an IGHV5-51*01, an IGHV5-51*02, an IGHV5-51*03, an IGHV5-51*04, an IGHV5-51*05, an IGHV6-1*01, an IGHV6-1*02, or is a modified germline segment thereof; a $D_H$ germline segment that is an IGHD2-2*01, an IGHD2-2*02, an IGHD2-15*01, an IGHD4-23*01, an IGHD6-6*01, an IGHD6-13*01, IGHD5-18*01, IGHD3-3*01, an IGHD3-3*02, an IGHD3-10*01, an IGHD3-10*02, or an IGHD7-27*01, or is a modified germline segment thereof; a $J_H$ germline segment that is an IGHJ1*01, an IGHJ2*01, an IGHJ4*01, an IGHJ4*02, an IGHJ4*03, an IGHJ6*01, an IGHJ6*02, an IGHJ6*03 or an IGHJ6*04 or is a modified germline segment thereof; a Vκ germline segment that is an IGKV1-5*01, an IGKV1-5*02, an IGKV1-5*03, an IGKV1-12*01, an IGKV1-12*02, an IGKV2-D-40*01, an IGKV3-11*01, an IGKV3-11*02, an IGKV3-15*01, an IGKV3-20*01 or an IGKV3-20*02 or is a modified germline segment thereof; a Jκ germline segment that is a IGKJ1*01 or is a modified germline segment thereof; a $V_\lambda$ germline segment that is an IGLV2-14*01, an IGLV2-14*02, an IGLV2-14*03, an IGLV2-14*04, an IGLV8-61*01, an IGLV8-61*02, an IGLV8-61*03, an IGLV5-48*01, or an IGLV11-55*01 or is a modified germline segment thereof; and/or a $J_\lambda$ germline segment that is a IGLJ1*01 or IGLJ4*01 or is a modified germline segment thereof.

The anti-DLL4 antibody provided herein includes an antibody or portion thereof containing: a) a VH chain encoded by a sequence of nucleotides compiled from an IGHV1-46*01, an IGHD6-6*01 and an IGHJ1*01 germline segments or modified forms thereof and a VL chain encoded by a sequence of nucleotides compiled from an IGKV3-11*01 and an IGKJ1*01 germline segments or modified forms thereof; b) a VH encoded by a sequence of nucleotides compiled from an IGHV5-51*03, an IGHD5-18*01 and an IGHJ4*01 germline segments or modified forms thereof and a VL chain encoded by a sequence of nucleotides compiled from an IGLV8-61*01 and an IGLJ1*01 germline segments or modified forms thereof; c) a VH chain encoded by a sequence of nucleotides compiled from an IGHV6-1*01, an IGHD3-3*01 and an IGHJ4*01 germline segments or modified forms thereof and a VL chain encoded by a sequence of nucleotides compiled from an IGLV5-48*01 and an IGLJ4*01 germline segments or a modified forms thereof; d) a VH chain encoded by a sequence of nucleotides compiled from an IGHV1-46*01, an IGHD6-13*01 and an IGHJ4*01 germline segments or modified forms thereof and a VL chain encoded by a sequence of nucleotides compiled from an IGKV3-15*01 and an IGKJ1*01 germline segments or modified forms thereof; e) a VH chain encoded by a sequence of nucleotides compiled from an IGHV4-34*01, an IGHD7-27*01 and an IGHJ4*01 germline segments or modified forms thereof and a VL chain encoded by a sequence of nucleotides compiled from an IGKV1-12*01 and an IGKJ1*01 germline segments or modified forms thereof; f) a VH chain encoded by a sequence of nucleotides compiled from an IGHV1-46*01, an IGHD6-13*01 and an IGHJ4*01 germline segments or modified forms thereof and a VL chain encoded by a sequence of nucleotides compiled from an IGKV3-20*01 and an IGKJ1*01 germline segments or modified forms thereof; g) a VH chain encoded by a sequence of nucleotides compiled from an IGHV1-3*02, an IGHD4-23*01 and an IGHJ4*01 germline segments or modified forms thereof and a VL chain encoded by a sequence of nucleotides compiled from an IGKV1-5*01 and an IGKJ1*01 germline segments or modified forms thereof; h) a VH chain encoded by a sequence of nucleotides compiled from an IGHV1-46*01, an IGHD2-15*01 and an IGHJ2*01 germline segments or modified forms thereof and a VL chain encoded by a sequence of nucleotides compiled from an IGKV1-5*01 and an IGKJ1*01 germline segments or modified forms thereof; i) a VH chain encoded by a sequence of nucleotides compiled from an IGHV1-46*01, an IGHD3-10*01 and an IGHJ4*01 germline segments or modified forms thereof and a VL chain encoded by a sequence of nucleotides compiled from an IGKV1-5*01 and an IGKJ1*01 germline segments or modified forms thereof; j) a VH chain encoded by a sequence of nucleotides compiled from an IGHV1-8*01, an IGHD2-2*01 and an IGHJ6*01 germline segments or modified forms thereof and a VL chain encoded by a sequence of nucleotides compiled from an IGKV1-5*01 and an IGKJ1*01 germline segments or modified forms thereof; k) a VH chain encoded by a sequence of nucleotides compiled from an IGHV1-46*01, an IGHD6-13*01 and an IGHJ4*01 germline segments or modified forms thereof and a VL chain encoded by a sequence of nucleotides compiled from an IGKV2D-40*01 and an IGKJ1*01 germline segments or modified forms thereof; I) a VH chain encoded by a sequence of nucleotides compiled from an IGHV4-34*01, an IGHD7-27*01 and an IGHJ4*01 germline segments or modified forms thereof and a VL chain encoded by a sequence of nucleotides compiled from an IGLV2-14*01 and an IGLJ4*01 germline segments or modified forms thereof; m) a VH chain encoded by a sequence of nucleotides compiled from an IGHV4-31*02, an IGHD2-15*01 and an IGHJ2*01 germline segments or modified forms thereof and a VL chain encoded by a sequence of nucleotides compiled from an IGLV2-14*01 and an IGLJ4*01 germline segments or modified forms thereof; and n) a VH chain encoded by a sequence of nucleotides compiled from an IGHV4-34*01, an IGHD7-27*01 and an IGHJ4*01 germline segments or modified forms thereof and a VL chain encoded by a sequence of nucleotides compiled from an IGLV11-55*01 and an IGLJ4*01 germline segments or a modified form thereof.

For example, exemplary of anti-DLL4 antibodies provided herein is an antibody containing a) a VH chain comprising a sequence of amino acids set forth in SEQ ID NO: 131 and a VL chain comprising a sequence of amino acids set forth in SEQ ID NO:141; b) a VH chain comprising a sequence of amino acids set forth in SEQ ID NO: 132 and a VL chain comprising a sequence of amino acids set forth in SEQ ID NO:142; c) a VH chain comprising a sequence of amino acids set forth in SEQ ID NO: 133 and a VL chain comprising a sequence of amino acids set forth in SEQ ID NO:143; d) a VH chain comprising a sequence of amino acids set forth in SEQ ID NO: 135 and a VL chain comprising a sequence of amino acids set forth in SEQ ID NO:145; e) a VH chain comprising a sequence of amino acids set forth in SEQ ID NO: 137 and a VL chain comprising a sequence of amino acids set forth in SEQ ID NO:146; f) a VH chain comprising a sequence of amino acids set forth in SEQ ID NO: 135 and a VL chain comprising a sequence of amino acids set forth in SEQ ID NO:144; g) a VH chain comprising a sequence of amino acids set forth in SEQ ID NO: 138 and a VL chain comprising a sequence of amino acids set forth in SEQ ID NO:147; h) a VH chain comprising a sequence of amino acids set forth in SEQ ID NO: 136 and a VL chain comprising a sequence of amino acids set forth in SEQ ID NO:147; i) a VH chain comprising a sequence of amino acids set forth in SEQ ID NO: 134 and a VL chain comprising a sequence of amino acids set forth in SEQ ID NO:147; j) a VH chain comprising a sequence of amino acids set forth in SEQ ID NO: 139 and a VL chain comprising a sequence of amino acids set forth in SEQ ID NO:147; k) a VH chain comprising a sequence of amino acids set forth in SEQ ID NO: 135 and a VL chain comprising a sequence of amino acids set forth in SEQ ID NO:148; l) a VH chain comprising a sequence of amino acids set forth in SEQ ID NO: 137 and a VL chain comprising a sequence of amino acids set forth in SEQ ID NO:149; m) a VH chain comprising a sequence of amino acids set forth in SEQ ID NO: 140 and a VL chain comprising a sequence of amino acids set forth in SEQ ID NO:149; or n) a VH chain comprising a sequence of amino acids set forth in SEQ ID NO: 137 and a VL chain comprising a sequence of amino acids set forth in SEQ ID NO:150.

In particular, an anti-DLL4 antibody provided herein contains a) a VH chain comprising a sequence of amino acids set forth in SEQ ID NO: 155 and a VL chain comprising a sequence of amino acids set forth in SEQ ID NO:141; b) a VH chain comprising a sequence of amino acids set forth in SEQ ID NO: 156 and a VL chain comprising a sequence of amino acids set forth in SEQ ID NO:141; or c) a VH chain comprising a sequence of amino acids set forth in SEQ ID NO: 385 and a VL chain comprising a sequence of amino acids set forth in SEQ ID NO:142.

In one example, anti-DLL4 antibodies provided herein have a binding affinity that is at least $19^{-9}$ M or lower as measured by surface plasmon resonance (SPR). Such antibodies include an antibody that contains a) a VH chain comprising a sequence of amino acids set forth in SEQ ID NO: 384 and a VL chain comprising a sequence of amino acids set forth in SEQ ID NO:142; b) a VH chain comprising a sequence of amino acids set forth in SEQ ID NO: 414 and a VL chain comprising a sequence of amino acids set forth in SEQ ID NO:142; c) a VH chain comprising a sequence of amino acids set forth in SEQ ID NO: 433 and a VL chain comprising a sequence of amino acids set forth in SEQ ID NO:142; d) a VH chain comprising a sequence of amino acids set forth in SEQ ID NO: 433 and a VL chain comprising a sequence of amino acids set forth in SEQ ID NO:479; e) a VH chain comprising a sequence of amino acids set forth in SEQ ID NO: 433 and a VL chain comprising a sequence of amino acids set forth in SEQ ID NO:537; f) a VH chain comprising a sequence of amino acids set forth in SEQ ID NO: 433 and a VL chain comprising a sequence of amino acids set forth in SEQ ID NO:536; g) a VH chain comprising a sequence of amino acids set forth in SEQ ID NO: 131 and a VL chain comprising a sequence of amino acids set forth in SEQ ID NO:141; h) a VH chain comprising a sequence of amino acids set forth in SEQ ID NO: 151 and a VL chain comprising a sequence of amino acids set forth in SEQ ID NO:141; i) a VH chain comprising a sequence of amino acids set forth in SEQ ID NO: 155 and a VL chain comprising a sequence of amino acids set forth in SEQ ID NO:141; j) a VH chain comprising a sequence of amino acids set forth in SEQ ID NO: 156 and a VL chain comprising a sequence of amino acids set forth in SEQ ID NO:141; k) a VH chain comprising a sequence of amino acids set forth in SEQ ID NO: 157 and a VL chain comprising a sequence of amino acids set forth in SEQ ID NO:141; l) a VH chain comprising a sequence of amino acids set forth in SEQ ID NO: 155 and a VL chain comprising a sequence of amino acids set forth in SEQ ID NO:266; m) a VH chain comprising a sequence of amino acids set forth in SEQ ID NO: 219 and a VL chain comprising a sequence of amino acids set forth in SEQ ID NO:141; n) a VH chain comprising a sequence of amino acids set forth in SEQ ID NO: 156 and a VL chain comprising a sequence of amino acids set forth in SEQ ID NO:343; o) a VH chain comprising a sequence of amino acids set forth in SEQ ID NO: 239 and a VL chain comprising a sequence of amino acids set forth in SEQ ID NO:343; p) a VH chain comprising a sequence of amino acids set forth in SEQ ID NO: 239 and a VL chain comprising a sequence of amino acids set forth in SEQ ID NO:370; or q) a VH chain comprising a sequence of amino acids set forth in SEQ ID NO: 134 and a VL chain comprising a sequence of amino acids set forth in SEQ ID NO:147.

In particular, included among anti-DLL4 antibodies provided herein is an antibody containing a VH chain comprising a sequence of amino acids set forth in SEQ ID NO: 433 and a VL chain comprising a sequence of amino acids set forth in SEQ ID NO:537. In another example, a DLL4 antibody provided herein contains a VH chain comprising a sequence of amino acids set forth in SEQ ID NO: 433 and a VL chain comprising a sequence of amino acids set forth in SEQ ID NO:536. In a further example, an anti-DLL4 antibody provided herein contains a VH chain comprising a sequence of amino acids set forth in SEQ ID NO:239 and a VL chain comprising a sequence of amino acids set forth in SEQ ID NO:343. In an additional example, an anti-DLL4 antibody provided herein contains a VH chain comprising a sequence of amino acids set forth in SEQ ID NO:239 and a VL chain comprising a sequence of amino acids set forth in SEQ ID NO:370.

Among the anti-DLL4 antibodies provided herein are those that exhibit affinity for recombinant human DLL4. In some examples, the antibody exhibits affinity for human DLL4 expressed on the surface of a cell. For example, anti-DLL4 antibodies can bind to DLL4 expressed on an endothelial cell.

Also included among anti-DLL4 antibodies provided herein are those that modulates an activity of DLL4. For example, anti-DLL4 antibodies provided herein can inhibits Notch activation. Anti-DLL4 antibodies include those that are agonists and those that are antagonist antibodies.

Further included among anti-DLL4 antibodies provided herein are those that specifically binds to an epitope in the EGF2 domain of DLL4. In another examples, anti-DLL4 antibodies provided herein specifically binds to an epitope within the EGF2 to EGF4 domains of DLL4. In a further example, anti-DLL4 antibodies provided herein include those that specifically bind to an epitope within the EGF3 to EGF4 domain of DLL4.

Provided herein are anti-DLL4 antibodies that specifically binds to the same epitope as any of the antibodies set forth above.

Provided herein is an anti-DLL4 antibody that specifically binds to a human DLL4 epitope within amino acids 283 to 360 of human DLL4 set forth in SEQ ID NO:114. Such an anti-DLL4 antibody includes an antibody that contains a CDRH1 that is GYSFTSYWIG (SEQ ID NO:831), or that has at least 65% sequence identity to SEQ ID NO:831; a CDRH2 that is IIYPGDSDTRYSPSFQG (SEQ ID NO:845), or that has at least 65% sequence identity to SEQ ID NO:845; a CDRH3 that is RGYSYGYDYFDY(SEQ ID NO:852), or that has at least 65% sequence identity to SEQ ID NO:852; a CDRL1 that is GLSSGSVSTSYYPS(SEQ ID NO:862), or that has at least 65% sequence identity to SEQ ID NO:862; a CDRL2 that is STNTRSS (SEQ ID NO:872), or that has at least 65% sequence identity to SEQ ID NO:872; and a CDRL3 that is VLYMGSGISYV (SEQ ID NO:882), or that has at least 65% sequence identity to SEQ ID NO:882.

In one example, such an antibody can be a full-length antibody or an antibody fragment. For example, the antibody fragment can be a Fab, Fab', F(ab')$_2$, single-chain Fvs (scFv), Fv, dsFv, diabody, Fd and Fd' fragments, Fab fragments, Fd fragments, scFv fragments, or a scFab fragments Generally, the antibody is a Fab or is a full-length IgG.

In another example, an anti-DLL4 that specifically binds the epitope within amino acids 283 to 360 includes an antibody where a CDR exhibits 70%, 75%, 80%, 85%, 90%, 91%, 92%, 93%, 94%, 95%, 96%, 97%, 98% or 99% sequence identity to the sequence of amino acids set forth in any of SEQ ID NOS: 831, 845, 852, 862, 872 and 882. For example, the anti-DLL4 antibody includes a CDRH1 that contains a modification of a CDRH1 set forth in SEQ ID NO:831 that has one or more amino acid replacement(s) at positions S28, F29, T30, W33, I34 and G35, based on kabat numbering. The one or more amino acid replacement(s) is selected from among S28A, S28R, S28K, S28N, F29A, T30A, W33A, I34A, G35T, G35A and/or G35V. The antibody also can contain a modification of a CDRH2 set forth in SEQ ID NO:845 that has one or more amino acid replacement(s) at positions I50, I51, Y52, P52a, D54, S55, D56 and/or T57, based on kabat numbering. The one or more amino acid replacement(s) is selected from among I150A, I51A, Y52A, P52aA, D54A, S55G, D56A, T57D and/or T57A. In a further example, the anti-DLL4 antibody can contains a modification of a CDRH3 set forth in SEQ ID NO: 852 that has one or more amino acid replacement(s) at positions R95, G96, Y97, S98, Y99, G100, Y100a, D100b, and/or D101, based on kabat numbering. The one or more amino acid replacement(s) is selected from among R95A, G96K, G96R, G96L, G96D, G96T, Y97A, Y97H, S98A, Y99A, G100A, G100D, G100L, G100P, G100R, G100M, G100K, G100S, G100R, G100T, Y100aA, D100bA and/or D101A. In particular, the amino acid replacement(s) is G96K/G100T. In an additional example, the anti-DLL4 contains a a modification of a CDRL1 set forth in SEQ ID NO:862 that has one or more amino acid replacement(s) at positions G24, L25, S26, S27, G27a, S27b, V27c, S28, T29, S30, Y31, Y32 and/or P33, based on kabat numbering. The one or more amino acid replacement(s) are selected from among G24A, G24R, G24L, L25A, S26A, S27A, G27aA, S27bA, V27cA, S28A, T29A, S30A, Y31A, Y32A and/or P33A. In another example, an anti-DLL4 antibody provided herein contains a modification of a CDRL2 set forth in SEQ ID NO:872 that has one or more amino acid replacement(s) at positions S50, T51, N52, T53, R54, S55 and/or S56, based on kabat numbering. The one or more amino acid replacement(s) are selected from among S50A, S50F, S50G, S50C, S50R, S50L, S50M, S50V, S50P, S50T, S50H, S50Q, S50N, S50K, S50D, S50E, S50W, T51A, T51F, T51L, T51I, T51M, T51V, T51S, T51P, T51Y, T51H, T51Q, T51N, T51K, T51D, T51E, T51W, T51R, T51G, N52A, T53A, R54A, R54I, R54Y, R54D, R54G, S55A, S55F, S55L, S55I, S55M, S55V, S55P, S55T, S55Y, S55H, S55Q, S55N, S55K, S55D, S55E, S55W, S55R, S55G and/or S56A. In yet another example, the anti-DLL4 antibody can contain a modification of a CDRL3 set forth in SEQ ID NO:882 that has one or more amino acid replacement(s) at positions V89, L90, Y91, M92, G93, S94, G95, I95a and/or S95b, based on kabat numbering. The one or more amino acid replacement(s) are selected from among V89A, V89P, V89T, V89S, V89L, V89R, V89C, V89E, V89W, V89N, V89I, V89G, V89H, L90A, Y91A, M92A, M92E, M92S, M92G, M92L, M92P, M92V, M92D, M92R, M92N, M92T, M92F, G93A, S94A, S94W, S94G, S94P, S94R, S94L, S94M, S94E, S94V, G94A, I95aA and/or S95bA. In particular, the amino acid replacement(s) are M92R/S94M or V89L/S94P. Exemplary of such anti-DLL4 antibodies provided herein is an antibody that has a VH chain comprising a sequence of amino acids set forth in SEQ ID NO: 433 and a VL chain comprising a sequence of amino acids set forth in SEQ ID NO:537.

Any of the anti-DLL4 antibodies provided be an isolated antibody.

Also provided herein is a polypeptide that has a sequence of amino acids set forth in any of SEQ ID NOS: 830-836 and 844-890; or has at least 65% identical to a sequence of amino acids set forth in any of SEQ ID NOS: 831-836 and 844-890, with the proviso that the polypeptide does not comprise the sequence of amino acids GYTFTSYVIN (SEQ ID NO:904); or has at least 72% identical to a sequence of amino acids set forth in SEQ ID NO:830; whereby when contained in an antibody or antigen-binding fragment or antibody fragment thereof specifically binds to human DLL4.

Provided herein is a polynucleotide(s) encoding any of the above-anti-DLL4 antibodies. Also provided herein is a polynucleotide encoding the variable heavy chain of any of the above anti-DLL4 antibodies. Also provided herein is a polynucleotide encoding the variable light chain of any of the above anti-DLL4 antibodies.

Provided herein is a vector containing any of the above polynucleotides. Also provided is a host cell containing any of the provided vectors. The host cell can be prokaryotic or eukaryotic.

Provided herein is a method of making an anti-DLL4 antibody by expressing any of the provided vectors in a suitable host cells and recovering the antibody.

Provided herein is a combination containing any of the above anti-DLL4 antibodies and an anti-angiogenic agent. The anti-angiogenic agent is an antagonist of vascular endothelial growth factor (VEGF). In one example, the VEGF antagonist is an anti-VEGF antibody. For example, the anti-VEGF antibody is bevacizumab.

Provided herein is a pharmaceutical composition containing any of the provided anti-DLL4 antibodies, polypeptides or combinations. The pharmaceutical can further contain a carrier. The pharmaceutical composition can be formulated as a gel, ointment, cream, paste, suppository, flush, liquid, suspension, aerosol, tablet, pill or powder. The pharmaceutical composition can be formulated for systemic, parenteral, topical, oral, mucosal, intranasal, subcutaneous, aerosolized, intravenous, bronchial, pulmonary, vaginal, vulvovaginal or esophageal administration. In some examples, the pharmaceutical composition is formulated for single dosage administration. In other examples, the pharmaceutical composition is formulated a sustained release formulation.

Provided herein is a method of treatment by administering a therapeutically effective amount of any one of the anti-DLL4 antibodies provided herein or any of the pharmaceutical compositions provided herein for treating a disease or disorder associated with expression and/or activity of DLL4. The disease or disorder is can be a tumor, cancer or cell proliferative disorder. For example, the disease or disorder can be atherosclerosis, arthritis, ocular neovascularization, endometriosis, uterine fibroids, pre-eclampsia and cancer. In one example, the disease or disorder is cancer and the cancer is prostate cancer, pancreatic cancer, colon cancer, lung cancer or breast cancer.

In the methods of treatment herein, any of the anti-DLL4 antibodies can be further administered in combination with an effective amount of an anti-angiogenic agent. The anti-angiogenic agent can be an antagonist of vascular endothelial growth factor (VEGF). For example, the VEGF antagonist is an anti-VEGF antibody. In one example, the anti-VEGF antibody is bevacizumab. Further provided herein are methods of treatment by administering any of the anti-DLL4 antibodies provided herein in combination with an effective amount of a chemotherapeutic agent.

Also provided herein is use of any of the anti-DLL4 antibodies provided herein in the formulation of a medicament for the treatment of a disease or disorder associated with expression and/or activity of DLL4. Further provided herein is a pharmaceutical composition containing any of the anti-DLL4 antibodies provided herein for use in treating a disease or disorder associated with expression and/or activity of DLL4.

Provided herein is a method of inhibiting Notch activation by administering any of the provided anti-DLL4 antibody that inactivates Notch signaling. Also provided is use of any of the anti-DLL4 antibodies in the formulation of a medicament for use in inhibiting Notch activation. Further provided is a pharmaceutical composition containing any of the provided anti-DLL4 antibodies for use in inhibiting Notch activation.

BRIEF DESCRIPTION OF THE FIGURES

FIG. 1. Sequence of DLL4 antibody VH1-46_IGHD6-6*01_IGHJ1*01 & L6_IGKJ1*01. FIG. 1 depicts the sequence of antibody VH1-46_IGHD6-6*01_IGHJ1*01 & L6_IGKJ1*01 (SEQ ID NOS:131 and 141) (in boldface type). FIG. 1A depicts the sequence of the variable heavy chain VH1-46_IGHD6-6*01_IGHJ1*01. FIG. 1B depicts the sequence of the variable light chain L6_IGKJ1*01. The sequences are numbered in sequential amino acid order (1st row) and according to Kabat (3rd row) and Chothia numbering (4th row). Framework (FW) and complementarity determining regions (CDRs) are identified.

FIG. 2. Sequence of DLL4 antibody VH5-51_IGHD5-18*01>3_IGHJ4*01 & V3-4_IGLJ1*01. FIG. 2 depicts the sequence of antibody VH5-51_IGHD5-18*01>3_IGHJ4*01 & V3-4_IGLJ1*01 (SEQ ID NOS:132 and 142) (in boldface type). FIG. 2A depicts the sequence of the variable heavy chain VH5-51_IGHD5-18*01>3_IGHJ4*01. FIG. 2B depicts the sequence of the variable light chain V3-4_IGLJ1*01. The sequences are numbered in sequential amino acid order (1st row) and according to Kabat (3rd row) and Chothia numbering (4th row). Framework (FW) and complementarity determining regions (CDRs) are identified.

DETAILED DESCRIPTION

Outline
A. Definitions
B. DLL4
  1. Structure
  2. Expression
  3. Function
C. Antibodies
  1. Germline-Derived Anti-DLL4 antibodies
    a. Exemplary Germline-derived anti-DLL4 antibodies
    b. Germline-Derived Modified Antibodies
      i. Variable heavy chain
      ii. Variable light chain
      iii. Exemplary Germline-Derived Modified Antibodies
  2. Anti-DLL4: Complementary Determining Regions (CDRs)
D. Further Modifications
  1. Modifications to reduce immunogenicity
  2. Fc Modifications
  3. Pegylation
  4. Conjugation of a Detectable Moiety
  5. Modifications to improve binding specificity
E. Methods of Generating or Identifying Anti-DLL4 Antibodies
  1. Immunization and Hybridoma Screening
  2. Screening Assays
    a. Display Libraries
      Phage Display Libraries
    b. Addressable Libraries
      Method of Generating a Combinatorial Addressable Antibody Library
  3. Optimization and Affinity Maturation
F. Assessing Anti-DLL4 Antibody Properties And Activities
  1. Binding
    a. Binding Assays
    b. Binding Affinity
  2. Functional Activity
  3. Animal Models
G. Methods of Production of Antibodies
  1. Vectors
  2. Cells and Expression Systems
    a. Prokaryotic Expression
    b. Yeast
    c. Insects
    d. Mammalian Cells
    e. Plants
  3. Purification
H. Formulations, Administration And Articles of Manufacture/Kits
  1. Formulations
  2. Articles of Manufacture and Kits
I. Methods and Uses of Antibodies
  1. Methods of Treatment and Uses
    Combination Therapy
  2. Diagnosis and Detection
J. Examples A. Definitions Unless defined otherwise, all technical and scientific terms used herein have the same meaning as is commonly understood by one of skill in the art to which the invention(s) belong. All patents, patent applications, published applications and publications, Genbank sequences, databases, websites and other published materials referred to throughout the entire disclosure herein, unless noted otherwise, are incorporated by reference in their entirety. In the event that there are a plurality of definitions for terms herein, those in this section prevail. Where reference is made to a URL or other such identifier or address, it understood that such identifiers can change and particular information on the internet can come and go, but equivalent information can be found by searching the internet. Reference thereto evidences the availability and public dissemination of such information.

As used herein, Delta-like 4 (DLL4) refers to a protein that is a ligand for Notch receptors 1 and 4. DLL4 includes any DLL4 polypeptide, including but not limited to, a recombinantly produced polypeptide, a sythentically produced polypeptide, a native DLL4 polypeptide, and a DLL4 polypeptide extracted from cells or tissues, including endothelial cells. DLL4 also includes related polypeptides from different species including, but not limited to animals of human and non-human origin. Human DLL4 includes DLL4, allelic variant isoforms, synthetic molecules from nucleic acids, protein isolated from human tissue and cells, and modified forms thereof. An exemplary DLL4 includes human DLL4 having a sequence of amino acids set forth in SEQ ID NO:114 and encoded by a sequence of nucleotides set forth in SEQ ID NO:113. For purposes herein, reference to DLL4 is typically with reference to human DLL4, unless stated otherwise.

As used herein, antibody refers to immunoglobulins and immunoglobulin portions, whether natural or partially or wholly synthetic, such as recombinantly, produced, including any portion thereof containing at least a portion of the variable region of the immunoglobulin molecule that is sufficient to form an antigen binding site. Hence, an antibody or portion thereof includes any protein having a binding domain that is homologous or substantially homologous to an immunoglobulin antigen binding site. For example, an antibody refers to an antibody that contains two heavy chains (which can be denoted H and H') and two light chains (which can be denoted L and L'), where each heavy chain can be a full-length immunoglobulin heavy chain or a portion thereof sufficient to form an antigen binding site (e.g. heavy chains include, but are not limited to, VH chains, VH-CH1 chains and VH-CH1-CH2-CH3 chains), and each light chain can be a full-length light chain or a portion thereof sufficient to form an antigen binding site (e.g. light chains include, but are not limited to, VL chains and VL-CL chains). Each heavy chain (H and H') pairs with one light chain (L and L', respectively). Typically, antibodies minimally include all or at least a portion of the variable heavy (VH) chain and/or the variable light (VL) chain. The antibody also can include all or a portion of the constant region.

For purposes herein, the term antibody includes full-length antibodies and portions thereof including antibody fragments, such as, but not limited to, Fab, Fab', F(ab')$_2$, single-chain Fvs (scFv), Fv, dsFv, diabody, Fd and Fd' fragments, Fab fragments, Fd fragments and scFv fragments. Other known fragments include, but are not limited to, scFab fragments (Hust et al., *BMC Biotechnology* (2007), 7:14). Antibodies include members of any immunoglobulin class, including IgG, IgM, IgA, IgD and IgE.

As used herein, a full-length antibody is an antibody having two full-length heavy chains (e.g. VH-CH1-CH2-CH3 or VH-CH1-CH2-CH3-CH4) and two full-length light chains (VL-CL) and hinge regions, such as human antibodies produced by antibody secreting B cells and antibodies with the same domains that are produced synthetically.

As used herein, antibody fragment or antibody portion refers to any portion of a full-length antibody that is less than full length but contains at least a portion of the variable region of the antibody sufficient to form an antigen binding site (e.g. one or more CDRs) and thus retains the a binding specificity and/or an activity of the full-length antibody; antibody fragments include antibody derivatives produced by enzymatic treatment of full-length antibodies, as well as synthetically, e.g. recombinantly produced derivatives. Examples of antibody fragments include, but are not limited to, Fab, Fab', F(ab')$_2$, single-chain Fvs (scFv), Fv, dsFv, diabody, Fd and Fd' fragments (see, for example, *Methods in Molecular Biology*, Vol 207: *Recombinant Antibodies for Cancer Therapy Methods and Protocols* (2003); Chapter 1; p 3-25, Kipriyanov). The fragment can include multiple chains linked together, such as by disulfide bridges and/or by peptide linkers. An antibody fragment generally contains at least about 50 amino acids and typically at least 200 amino acids.

As used herein, an Fv antibody fragment is composed of one variable heavy domain (VH) and one variable light (VL) domain linked by noncovalent interactions.

As used herein, a dsFv refers to an Fv with an engineered intermolecular disulfide bond, which stabilizes the VH-VL pair.

As used herein, an Fd fragment is a fragment of an antibody containing a variable domain (VH) and one constant region domain (CH1) of an antibody heavy chain.

As used herein, Fab fragment is an antibody fragment that contains the portion of the full-length antibody that results from digestion of a full-length immunoglobulin with papain, or a fragment having the same structure that is produced synthetically, e.g. recombinantly. A Fab fragment contains a light chain (containing a VL and CL portion) and another chain containing a variable domain of a heavy chain (VH) and one constant region domain portion of the heavy chain (CH1); it can be recombinantly produced.

As used herein, a F(ab')$_2$ fragment is an antibody fragment that results from digestion of an immunoglobulin with pepsin at pH 4.0-4.5, or a synthetically, e.g. recombinantly, produced antibody having the same structure. The F(ab')$_2$ fragment contains two Fab fragments but where each heavy chain portion contains an additional few amino acids, including cysteine residues that form disulfide linkages joining the two fragments; it can be recombinantly produced.

As used herein, a Fab' fragment is a fragment containing one half (one heavy chain and one light chain) of the F(ab')$_2$ fragment.

As used herein, an Fd' fragment is a fragment of an antibody containing one heavy chain portion of a F(ab')$_2$ fragment.

As used herein, an Fv fragment is a fragment containing only the $V_H$ and $V_L$ domains of an antibody molecule.

As used herein, a scFv fragment refers to an antibody fragment that contains a variable light chain (VL) and variable heavy chain (VH), covalently connected by a polypeptide linker in any order. The linker is of a length such that the two variable domains are bridged without substantial interference. Exemplary linkers are (Gly-Ser)$_n$ residues with some Glu or Lys residues dispersed throughout to increase solubility.

As used herein, diabodies are dimeric scFv; diabodies typically have shorter peptide linkers than scFvs, and they preferentially dimerize.

As used herein, hsFv refers to antibody fragments in which the constant domains normally present in a Fab fragment have been substituted with a heterodimeric coiled-coil domain (see, e.g., Arndt et al. (2001) *J Mol Biol.* 7:312:221-228).

As used herein, a polypeptide domain is a part of a polypeptide (a sequence of three or more, generally 5 or 7 or more amino acids) that is a structurally and/or functionally distinguishable or definable. Exemplary of a polypeptide domain is a part of the polypeptide that can form an independently folded structure within a polypeptide made up of one or more structural motifs (e.g. combinations of alpha helices and/or beta strands connected by loop regions) and/or that is recognized by a particular functional activity, such as enzymatic activity or antigen binding. A polypeptide can have one, typically more than one, distinct domains. For example, the polypeptide can have one or more structural domains and one or more functional domains. A single polypeptide domain can be distinguished based on structure and function. A domain can encompass a contiguous linear sequence of amino acids. Alternatively, a domain can encompass a plurality of non-contiguous amino acid portions, which are non-contiguous along the linear sequence of amino acids of the polypeptide. Typically, a polypeptide contains a plurality of domains. For example, each heavy chain and each light chain of an antibody molecule contains a plurality of immunoglobulin (Ig) domains, each about 110 amino acids in length. Domains (i.e., EGF, an Ig-like domain) often are identified by virtue of structural and/or sequence homology to domains in particular proteins. For exemplification herein, definitions are provided, but it is understood that it is well within the skill in the art to recognize particular domains by name. If needed appropriate software can be employed to identify domains. Further, reference to the amino acids positions of a domain herein are for exemplification purposes only. Since interactions are dynamic, amino acid positions noted are for reference and exemplification. The noted positions reflects a range of loci that vary by 2, 3, 4, 5 or more amino acids. Variations also exist among allelic variants and species variants. Those of skill in the art can identify corresponding sequences by visual comparison or other comparisons including readily available algorithms and software.

As used herein, an Ig domain is a domain, recognized as such by those in the art, that is distinguished by a structure, called the Immunoglobulin (Ig) fold, which contains two beta-pleated sheets, each containing anti-parallel beta strands of amino acids connected by loops. The two beta sheets in the Ig fold are sandwiched together by hydrophobic interactions and a conserved intra-chain disulfide bond. Individual immunoglobulin domains within an antibody chain further can be distinguished based on function. For example, a light chain contains one variable region domain (VL) and one constant region domain (CL), while a heavy chain contains one variable region domain (VH) and three or four constant region domains (CH). Each VL, CL, VH, and CH domain is an example of an immunoglobulin domain.

As used herein, a variable domain with reference to an antibody is a specific Ig domain of an antibody heavy or light chain that contains a sequence of amino acids that varies among different antibodies. Each light chain and each heavy chain has one variable region domain (VL and VH). The variable domains provide antigen specificity, and thus are responsible for antigen recognition. Each variable region contains CDRs that are part of the antigen binding site domain and framework regions (FRs).

As used herein, "hypervariable region," "HV," "complementarity-determining region," "CDR" and "antibody CDR" are used interchangeably to refer to one of a plurality of portions within each variable region that together form an antigen binding site of an antibody. Each variable region domain contains three CDRs, named CDR1, CDR2, and CDR3. The three CDRs are non-contiguous along the linear amino acid sequence, but are proximate in the folded polypeptide. The CDRs are located within the loops that join the parallel strands of the beta sheets of the variable domain.

As used herein, framework regions (FRs) are the domains within the antibody variable region domains that are located within the beta sheets; the FR regions are comparatively more conserved, in terms of their amino acid sequences, than the hypervariable regions.

As used herein, a constant region domain is a domain in an antibody heavy or light chain that contains a sequence of amino acids that is comparatively more conserved among antibodies than the variable region domain. Each light chain has a single light chain constant region (CL) domain and each heavy chain contains one or more heavy chain constant region (CH) domains, which include, CH1, CH2, CH3 and CH4. Full-length IgA, IgD and IgG isotypes contain CH1, CH2, CH3 and a hinge region, while IgE and IgM contain CH1, CH2, CH3 and CH4. CH1 and CL domains extend the Fab arm of the antibody molecule, thus contributing to the interaction with antigen and rotation of the antibody arms. Antibody constant regions can serve effector functions, such as, but not limited to, clearance of antigens, pathogens and toxins to which the antibody specifically binds, e.g. through interactions with various cells, biomolecules and tissues.

As used herein, humanized antibodies refer to antibodies that are modified to include "human" sequences of amino acids so that administration to a human does not provoke an immune response. Methods for preparation of such antibodies are known. For example, the antibody in which the amino acid composition of the non-variable regions can be based on human antibodies. Computer programs have been designed to identify such regions.

As used herein, "antigen-binding site" refers to the interface formed by one or more complementary determining regions (CDRs; also called hypervariable region). Each antigen binding site contains three CDRs from the heavy chain variable region and three CDRs from the light chain variable region. An antibody molecule has two antigen combining sites, each containing portions of a heavy chain variable region and portions of a light chain variable region. The antigen combining sites can contain other portions of the variable region domains in addition to the CDRs.

As used herein, reference to an "antibody or portion thereof that is sufficient to form an antigen binding site" means that the antibody or portion thereof contains at least 1 or 2, typically 3, 4, 5 or all 6 CDRs of the VH and VL sufficient to retain at least a portion of the binding specificity of the corresponding full-length antibody containing all 6 CDRs. Generally, a sufficient antigen binding site at least requires CDR3 of the heavy chain (CDRH3). It typically further requires the CDR3 of the light chain (CDRL3). As described herein, one of skill in the art knows and can identify the CDRs based on Kabat or Chothia numbering (see e.g., Kabat, E. A. et al. (1991) *Sequences of Proteins of Immunological Interest*, Fifth Edition, U.S. Department of Health and Human Services, NIH Publication No. 91-3242, and Chothia, C. et al. (1987) *J. Mol. Biol.* 196:901-917). For example, based on Kabat numbering, CDR-L1 corresponds to residues L24-L34; CDR-L2 corresponds to residues L50-L56; CDR-L3 corresponds to residues L89-L97; CDR-H1 corresponds to residues H31-H35, 35a or 35b depending on the length; CDR-H2 corresponds to residues H50-H65; and CDR-H3 corresponds to residues H95-H102.

As used herein, a "target protein" refers to candidate proteins or peptides that are specifically recognized by an antibody or portion thereof and/or whose activity is modulated by an antibody or portion thereof. A target protein includes any peptide or protein that contains an epitope for antibody recognition. Target proteins include proteins involved in the etiology of a disease or disorder by virtue of expression or activity. An exemplary target protein is DLL4.

As used herein, activity towards a target protein (e.g. DLL4) refers to binding specificity and/or modulation of a functional activity of a target protein, or other measurements that reflects the activity of an antibody or portion thereof towards a target protein.

As used herein, the term assessing is intended to include quantitative and qualitative determination in the sense of obtaining an absolute value for the binding of an antibody or portion thereof with a target protein and/or modulation of an activity of a target protein by an antibody or portion thereof, and also of obtaining an index, ratio, percentage, visual or other value indicative of the level of the binding or activity. Assessment can be direct or indirect. For example, binding can be determined by directly labeling an antibody or portion thereof with a detectable label and/or by using a secondary antibody that itself is labeled. In addition, functional activities can be determined using any of a variety of assays known to one of skill in the art, for example, proliferation, cytotoxicity and others as described herein, and comparing the activity of the target protein in the presence versus the absence of an antibody or portion thereof.

As used herein, "functional activity" refer to activities of a polypeptide (e.g. target protein) or portion thereof associated with a full-length (complete) protein. Functional activities include, but are not limited to, biological activity, catalytic or enzymatic activity, antigenicity (ability to bind to or compete with a polypeptide for binding to an anti-polypeptide antibody), immunogenicity, ability to form multimers, the ability to specifically bind to a receptor or ligand for the polypeptide and signaling and downstream effector functions. For purposes herein, modulation (i.e. activation or inhibition) of a functional activity of a polypeptide by an antibody or portion thereof means that a functional activity of the polypeptide is changed or altered in the presence of the antibody compared to the absence of the antibody or portion thereof.

As used herein, "modulate" or "modulation" and other various grammatical forms thereof with reference to the effect of an antibody or portion thereof on the functional activity of a target protein refers to increased activity such as induction or potentiation of activity, as well as inhibition of one or more activities of the target protein. Hence, modulation can include an increase in the activity (i.e., up-regulation or agonist activity), a decrease in activity (i.e., down-regulation or inhibition) or any other alteration in an activity (such as a change in periodicity, frequency, duration, kinetics or other parameter). Modulation can be context dependent and typically modulation is compared to a designated state, for example, the wildtype protein, the protein in a constitutive state, or the protein as expressed in a designated cell type or condition. The functional activity of a target protein by an antibody or portion thereof can be modulated by 10%, 20%, 30%, 40%, 50%, 60%, 70%, 80%, 90% or more compared to the activity of the target protein in the absence of the antibody or portion thereof.

As used herein, "agonist" refers to an antibody or portion thereof that modulates signal transduction or other functional activity of a receptor by potentiating, inducing or otherwise enhancing the signal transduction activity or other functional activity of a receptor. Agonists can modulate signal transduction or other functional activity when used alone or can alter signal transduction or other functional activity in the presence of the natural ligand of the receptor or other receptor stimulator to enhance signaling by the receptor compared to the ligand alone.

As used herein, "antagonist" refers to an antibody or portion thereof that modulates signal transduction or other functional activity of a receptor by blocking or decreasing the signal transduction activity or other functional activity of a receptor As used herein, a label is a detectable marker that can be attached or linked directly or indirectly to a molecule or associated therewith. The detection method can be any method known in the art.

As used herein, binding activity refer to characteristics of a molecule, e.g. a polypeptide, relating to whether or not, and how, it binds one or more binding partners. Binding activities include ability to bind the binding partner(s), the affinity with which it binds to the binding partner (e.g. high affinity), the avidity with which it binds to the binding partner, the strength of the bond with the binding partner and specificity for binding with the binding partner.

As used herein, "affinity" or "binding affinity" refers to the strength with which an antibody molecule or portion thereof binds to an epitope on a target protein or antigen. Affinity is often measured by equilibrium association constant ($K_A$) or equilibrium dissociation constant ($K_D$). Low-affinity antibody-antigen interaction is weak, and the molecules tend to dissociate rapidly, while high affinity antibody-antigen binding is strong and the molecules remain bound for a longer amount of time. A high antibody affinity means that the antibody specifically binds to a target protein with an equilibrium association constant ($K_A$) of greater than or equal to about $10^6$ $M^{-1}$, greater than or equal to about $10^7$ $M^{-1}$, greater than or equal to about $10^8$ $M^{-1}$, or greater than or equal to about $10^9$ $M^{-1}$, $10^{10}$ $M^{-1}$, $10^{11}$ $M^{-1}$ or $10^{12}$ $M^{-1}$. Antibodies also can be characterized by an equilibrium dissociation constant ($K_D$), for example, $10^{-6}$ M, $10^{-7}$ M, $10^{-8}$ M, $10^{-9}$ M, $10^{-10}$ M, $10^{-11}$ M or $10^{-12}$ M or lower. Generally, antibodies having a nanomolar or sub-nanomolar dissociaton constant are deemed to be high affinity antibodies. Such affinities can be readily determined using conventional techniques, such as by equilibrium dialysis; by using surface plasmon resonance; by radioimmunoassay using radiolabeled target antigen; or by another method known to the skilled artisan. The affinity data can be analyzed, for example, by the method of Scatchard et al., Ann N.Y. Acad. ScL, 51:660 (1949).

As used herein, "specifically bind" or "immunospecifically bind" with respect to an antibody or antigen-binding fragment thereof are used interchangeably herein and refer to the ability of the antibody or antigen-binding fragment to form one or more noncovalent bonds with a cognate antigen, by noncovalent interactions between the antibody combining site(s) of the antibody and the antigen (e.g. human DLL4). Typically, an antibody that immunospecifically binds (or that specifically binds) to an antigen is one that binds to the antigen with an affinity constant Ka of about or $1 \times 10^7$ $M^{-1}$ or $1 \times 10^8$ $M^{-1}$ or greater (or a dissociation constant ($K_d$) of $1 \times 10^{-7}$ M or $1 \times 10^{-8}$ M or less). Affinity constants can be determined by standard kinetic methodology for antibody reactions, for example, immunoassays, surface plasmon resonance (SPR) (Rich and Myszka (2000) *Curr. Opin. Biotechnol* 11:54; Englebienne (1998) *Analyst.* 123:1599), isothermal titration calorimetry (ITC) or other kinetic interaction assays known in the art (see, e.g., Paul, ed., Fundamental Immunology, 2nd ed., Raven Press, New York, pages 332-336 (1989); see also U.S. Pat. No. 7,229,619 for a description of exemplary SPR and ITC methods for calculating the binding affinity of anti-RSV antibodies). Instrumentation and methods for real time detection and monitoring of binding rates are known and are commercially available (e.g., BiaCore 2000, Biacore AB, Upsala, Sweden and GE Healthcare Life Sciences; Malmqvist (2000) *Biochem. Soc. Trans.* 27:335).

As used herein, the term "bind selectively" or "selectively binds," in reference to a polypeptide or an antibody provided herein, means that the polypeptide or antibody binds with a selected epitope without substantially binding to another epitope. Typically, an antibody or fragment thereof that selectively binds to a selected epitope specifically binds to the epitope, such as with an affinity constant Ka of about or $1 \times 10^7 M^{-1}$ or $1 \times 10^8 M^{-1}$ or greater.

As used herein, "epitope" refers to the localized region on the surface of an antigen or protein that is recognized by an antibody. An epitope can be a linear or conformational epitope, and can be continuous or discontinuous. Typically, linear epitopes are continuous, i.e. made up of one continuous stretch of amino acids. Conformational epitopes can be discontinuous i.e. made up of two or more discontinuous segments of amino acids that come together to form an epitope when the antigen is folded. Methods for determining whether antibodies binds to the same epitope are known in the art. Epitopes can be defined or mapped by standard methods well known in art. For example, epitopes can be mapped using assays, such as ELISA assays, utilizing peptide libraries or site-directed mutagenesis of the antigen (such as alanine-scanning of the antigen).

As used herein, "binds to the same epitope" with reference to two or more antibodies means that the antibodies compete for binding to an antigen and bind to the same, overlapping or encompassing continuous or discontinuous segments of amino acids. Those of skill in the art understand that the phrase "binds to the same epitope" does not necessarily mean that the antibodies bind to exactly the same amino acids. The precise amino acids to which the antibodies bind can differ.

For example, a first antibody can bind to a segment of amino acids that is completely encompassed by the segment of amino acids bound by a second antibody. In another example, a first antibody binds one or more segments of amino acids that significantly overlap the one or more segments bound by the second antibody. For the purposes herein, such antibodies are considered to "bind to the same epitope."

Antibody competition assays can be used to determine whether an antibody "binds to the same epitope" as another antibody. Such assays are well known on the art and are described herein (see. e.g. Example 9). Typically, competition of 70% or more, such as 70%, 71%, 72%, 73%, 74%, 75%, 80%, 85%, 90%, 95% or more, of an antibody known to interact with the epitope by a second antibody under conditions in which the second antibody is in excess and the first saturates all sites, is indicative that the antibodies "bind to the same epitope." To assess the level of competition between two antibodies, for example, radioimmunoassays or assays using other labels for the antibodies, can be used. For example, a DLL4 antigen can be incubated with a a saturating amount of a first anti-DLL4 antibody or antigen-binding fragment thereof conjugated to a labeled compound (e.g., $^{3}$H, $^{125}$I, biotin, or rubidium) in the presence the same amount of a second unlabeled anti-DLL4 antibody. The amount of labeled antibody that is bound to the antigen in the presence of the unlabeled blocking antibody is then assessed and compared to binding in the absence of the unlabeled blocking antibody. Competition is determined by the percentage change in binding signals in the presence of the unlabeled blocking antibody compared to the absence of the blocking antibody. Thus, if there is a 70% inhibition of binding of the labeled antibody in the presence of the blocking antibody compared to binding in the absence of the blocking antibody, then there is competition between the two antibodies of 70%. Thus, reference to competition between a first and second antibody of 70% or more, such as 70%, 71%, 72%, 73%, 74%, 75%, 80%, 85%, 90%, 95% or more, means that the first antibody inhibits binding of the second antibody (or vice versa) to the antigen by 70%, 71%, 72%, 73%, 74%, 75%, 80%, 85%, 90%, 95% or more (compared to binding of the antigen by the second antibody in the absence of the first antibody). Thus, inhibition of binding of a first antibody to an antigen by a second antibody of 70%, 71%, 72%, 73%, 74%, 75%, 80%, 85%, 90%, 95% or more indicates that the two antibodies bind to the same epitope.

As used herein, the term "surface plasmon resonance" refers to an optical phenomenon that allows for the analysis of real-time interactions by detection of alterations in protein concentrations within a biosensor matrix, for example, using the BiaCore system (GE Healthcare Life Sciences).

As used herein, a "bispecific" antibody is a multispecific antibody that contains two or more antigen-binding sites and can immunospecifically bind to two different epitopes. A "trispecific" antibody is a multispecific antibody that contains three or more antigen-binding sites and can immunospecifically bind to three different epitopes, a "tetraspecific" antibody is a multispecific antibody that contains four or more antigen-binding sites and can immunospecifically bind to four different epitopes, and so on.

As used herein, "epitope mapping" is the process of identification of the molecular determinants for antibody-antigen recognition.

As used herein, Basic Local Alignment Search Tool (BLAST) is a search algorithm developed by Altschul et al. *J Mol Biol.* 215(3):403-10 (1990) to separately search protein or DNA databases, for example, based on sequence identity. For example, blastn is a program that compares a nucleotide query sequence against a nucleotide sequence database (e.g. GenBank). BlastP is a program that compares an amino acid query sequence against a protein sequence database.

As used herein, a BLAST bit score is a value calculated from the number of gaps and substitutions associated with each aligned sequence. The higher the score, the more significant the alignment.

As used herein, a human protein is one encoded by a nucleic acid molecule, such as DNA, present in the genome of a human, including all allelic variants and conservative variations thereof. A variant or modification of a protein is a human protein if the modification is based on the wildtype or prominent sequence of a human protein.

As used herein, "naturally occurring amino acids" refers to the 20 L-amino acids that occur in polypeptides. The residues are those 20 α-amino acids found in nature which are incorporated into protein by the specific recognition of the charged tRNA molecule with its cognate mRNA codon in humans.

As used herein, "non-naturally occurring amino acids" refers to amino acids that are not genetically encoded. For example, a non-natural amino acid is an organic compound that has a structure similar to a natural amino acid but has been modified structurally to mimic the structure and reactivity of a natural amino acid. Non-naturally occurring amino acids thus include, for example, amino acids or analogs of amino acids other than the 20 naturally-occurring amino acids and include, but are not limited to, the D-isostereomers of amino acids. Exemplary non-natural amino acids are known to those of skill in the art.

As used herein, nucleic acids include DNA, RNA and analogs thereof, including peptide nucleic acids (PNA) and mixtures thereof. Nucleic acids can be single or double-stranded. When referring to probes or primers, which are optionally labeled, such as with a detectable label, such as a fluorescent or radiolabel, single-stranded molecules are contemplated. Such molecules are typically of a length such that their target is statistically unique or of low copy number (typically less than 5, generally less than 3) for probing or priming a library. Generally a probe or primer contains at least 14, 16 or 30 contiguous nucleotides of sequence complementary to or identical to a gene of interest. Probes and primers can be 10, 20, 30, 50, 100 or more nucleic acids long.

As used herein, a peptide refers to a polypeptide that is from 2 to 40 amino acids in length.

As used herein, amino acids which occur in the various sequences of amino acids provided herein are identified according to their known, three-letter or one-letter abbreviations (Table 1). The nucleotides which occur in the various nucleic acid fragments are designated with the standard single-letter designations used routinely in the art.

As used herein, an "amino acid" is an organic compound containing an amino group and a carboxylic acid group. A polypeptide contains two or more amino acids. For purposes herein, amino acids include the twenty naturally-occurring amino acids, non-natural amino acids and amino acid analogs (i.e., amino acids wherein the α-carbon has a side chain).

As used herein, "amino acid residue" refers to an amino acid formed upon chemical digestion (hydrolysis) of a polypeptide at its peptide linkages. The amino acid residues described herein are presumed to be in the "L" isomeric form. Residues in the "D" isomeric form, which are so designated, can be substituted for any L-amino acid residue as long as the desired functional property is retained by the polypeptide. NH$_2$ refers to the free amino group present at the amino terminus of a polypeptide. COOH refers to the free carboxy group present at the carboxyl terminus of a polypeptide. In keeping with standard polypeptide nomenclature described in *J. Biol. Chem.*, 243:3557-3559 (1968), and adopted 37 C.F.R. '§§1.821-1.822, abbreviations for amino acid residues are shown in Table 1:

TABLE 1

Table of Correspondence

| SYMBOL | | |
|---|---|---|
| 1-Letter | 3-Letter | AMINO ACID |
| Y | Tyr | Tyrosine |
| G | Gly | Glycine |
| F | Phe | Phenylalanine |
| M | Met | Methionine |
| A | Ala | Alanine |
| S | Ser | Serine |
| I | Ile | Isoleucine |
| L | Leu | Leucine |
| T | Thr | Threonine |
| V | Val | Valine |
| P | Pro | Proline |
| K | Lys | Lysine |
| H | His | Histidine |
| Q | Gln | Glutamine |
| E | Glu | Glutamic acid |
| Z | Glx | Glu and/or Gln |
| W | Trp | Tryptophan |
| R | Arg | Arginine |
| D | Asp | Aspartic acid |
| N | Asn | Asparagine |
| B | Asx | Asn and/or Asp |
| C | Cys | Cysteine |
| X | Xaa | Unknown or other |

It is noted that all amino acid residue sequences represented herein by formulae have a left to right orientation in the conventional direction of amino-terminus to carboxyl-terminus. In addition, the phrase "amino acid residue" is broadly defined to include the amino acids listed in the Table of Correspondence (Table 1) and modified and unusual amino acids, such as those referred to in 37 C.F.R. §§1.821-1.822, and incorporated herein by reference. Furthermore, it is noted that a dash at the beginning or end of an amino acid residue sequence indicates a peptide bond to a further sequence of one or more amino acid residues, to an amino-terminal group such as $NH_2$ or to a carboxyl-terminal group such as COOH. The abbreviations for any protective groups, amino acids and other compounds, are, unless indicated otherwise, in accord with their common usage, recognized abbreviations, or the IUPAC-IUB Commission on Biochemical Nomenclature (see, (1972) *Biochem.* 11:1726). Each naturally occurring L-amino acid is identified by the standard three letter code (or single letter code) or the standard three letter code (or single letter code) with the prefix "L-"; the prefix "D-" indicates that the stereoisomeric form of the amino acid is D.

As used herein, an isokinetic mixture is one in which the molar ratios of amino acids has been adjusted based on their reported reaction rates (see, e.g., Ostresh et al., (1994) *Biopolymers* 34:1681).

As used herein, modification is in reference to modification of a sequence of amino acids of a polypeptide or a sequence of nucleotides in a nucleic acid molecule and includes deletions, insertions, and replacements of amino acids and nucleotides, respectively. Methods of modifying a polypeptide are routine to those of skill in the art, such as by using recombinant DNA methodologies.

As used herein, suitable conservative substitutions of amino acids are known to those of skill in this art and can be made generally without altering the biological activity of the resulting molecule. Those of skill in this art recognize that, in general, single amino acid substitutions in non-essential regions of a polypeptide do not substantially alter biological activity (see, e.g., Watson et al. Molecular Biology of the Gene, 4th Edition, 1987, The Benjamin/Cummings Pub. co., p. 224). Such substitutions can be made in accordance with those set forth in TABLE 2 as follows:

TABLE 2

| Original residue | Exemplary conservative substitution |
|---|---|
| Ala (A) | Gly; Ser |
| Arg (R) | Lys |
| Asn (N) | Gln; His |
| Cys (C) | Ser |
| Gln (Q) | Asn |
| Glu (E) | Asp |
| Gly (G) | Ala; Pro |
| His (H) | Asn; Gln |
| Ile (I) | Leu; Val |
| Leu (L) | Ile; Val |
| Lys (K) | Arg; Gln; Glu |
| Met (M) | Leu; Tyr; Ile |
| Phe (F) | Met; Leu; Tyr |
| Ser (S) | Thr |
| Thr (T) | Ser |
| Trp (W) | Tyr |
| Tyr (Y) | Trp; Phe |
| Val (V) | Ile; Leu |

Other substitutions also are permissible and can be determined empirically or in accord with known conservative substitutions.

As used herein, a DNA construct is a single or double stranded, linear or circular DNA molecule that contains segments of DNA combined and juxtaposed in a manner not found in nature. DNA constructs exist as a result of human manipulation, and include clones and other copies of manipulated molecules.

As used herein, a DNA segment is a portion of a larger DNA molecule having specified attributes. For example, a DNA segment encoding a specified polypeptide is a portion of a longer DNA molecule, such as a plasmid or plasmid fragment, which, when read from the 5' to 3' direction, encodes the sequence of amino acids of the specified polypeptide.

As used herein, the term "nucleic acid" refers to single-stranded and/or double-stranded polynucleotides such as deoxyribonucleic acid (DNA), and ribonucleic acid (RNA) as well as analogs or derivatives of either RNA or DNA. Also included in the term "nucleic acid" are analogs of nucleic acids such as peptide nucleic acid (PNA), phosphorothioate DNA, and other such analogs and derivatives or combinations thereof. Nucleic acid can refer to polynucleotides such as deoxyribonucleic acid (DNA) and ribonucleic acid (RNA). The term also includes, as equivalents, derivatives, variants and analogs of either RNA or DNA made from nucleotide analogs, single (sense or antisense) and double-stranded polynucleotides. Deoxyribonucleotides include deoxyadenosine, deoxycytidine, deoxyguanosine and deoxythymidine. For RNA, the uracil base is uridine.

As used herein, "nucleic acid molecule encoding" refers to a nucleic acid molecule which directs the expression of a specific protein or peptide. The nucleic acid sequences include both the DNA strand sequence that is transcribed into RNA and the RNA sequence that is translated into protein or peptide. The nucleic acid molecule includes both the full length nucleic acid sequences as well as non-full length sequences derived from the full length mature polypeptide, such as for example a full length polypeptide lacking a precursor sequence. For purposes herein, a nucleic acid sequence also includes the degenerate codons of the native sequence or sequences that can be introduced to provide codon preference in a specific host.

As used herein, the term "polynucleotide" refers to an oligomer or polymer containing at least two linked nucleotides or nucleotide derivatives, including a deoxyribonucleic acid (DNA), a ribonucleic acid (RNA), and a DNA or RNA derivative containing, for example, a nucleotide analog or a "backbone" bond other than a phosphodiester bond, for example, a phosphotriester bond, a phosphoramidate bond, a phosphorothioate bond, a thioester bond, or a peptide bond (peptide nucleic acid). The term "oligonucleotide" also is used herein essentially synonymously with "polynucleotide," although those in the art recognize that oligonucleotides, for example, PCR primers, generally are less than about fifty to one hundred nucleotides in length.

Polynucleotides can include nucleotide analogs, including, for example, mass modified nucleotides, which allow for mass differentiation of polynucleotides; nucleotides containing a detectable label such as a fluorescent, radioactive, luminescent or chemiluminescent label, which allow for detection of a polynucleotide; or nucleotides containing a reactive group such as biotin or a thiol group, which facilitates immobilization of a polynucleotide to a solid support. A polynucleotide also can contain one or more backbone bonds that are selectively cleavable, for example, chemically, enzymatically or photolytically. For example, a polynucleotide can include one or more deoxyribonucleotides, followed by one or more ribonucleotides, which can be followed by one or more deoxyribonucleotides, such a sequence being cleavable at the ribonucleotide sequence by base hydrolysis. A polynucleotide also can contain one or more bonds that are relatively resistant to cleavage, for example, a chimeric oligonucleotide primer, which can include nucleotides linked by peptide nucleic acid bonds and at least one nucleotide at the 3' end, which is linked by a phosphodiester bond or other suitable bond, and is capable of being extended by a polymerase. Peptide nucleic acid sequences can be prepared using well-known methods (see, for example, Weiler et al. *Nucleic acids Res.* 25: 2792-2799 (1997)).

As used herein, "similarity" between two proteins or nucleic acids refers to the relatedness between the sequence of amino acids of the proteins or the nucleotide sequences of the nucleic acids. Similarity can be based on the degree of identity and/or homology of sequences of residues and the residues contained therein. Methods for assessing the degree of similarity between proteins or nucleic acids are known to those of skill in the art. For example, in one method of assessing sequence similarity, two amino acid or nucleotide sequences are aligned in a manner that yields a maximal level of identity between the sequences. "Identity" refers to the extent to which the amino acid or nucleotide sequences are invariant. Alignment of amino acid sequences, and to some extent nucleotide sequences, also can take into account conservative differences and/or frequent substitutions in amino acids (or nucleotides). Conservative differences are those that preserve the physico-chemical properties of the residues involved. Alignments can be global (alignment of the compared sequences over the entire length of the sequences and including all residues) or local (the alignment of a portion of the sequences that includes only the most similar region or regions).

"Identity" per se has an art-recognized meaning and can be calculated using published techniques. (See, e.g.: *Computational Molecular Biology*, Lesk, A. M., ed., Oxford University Press, New York, 1988; *Biocomputing: Informatics and Genome Projects*, Smith, D. W., ed., Academic Press, New York, 1993; *Computer Analysis of Sequence Data*, Part I, Griffin, A. M., and Griffin, H. G., eds., Humana Press, New Jersey, 1994; *Sequence Analysis in Molecular Biology*, von Heinje, G., Academic Press, 1987; and Sequence Analysis Primer, Gribskov, M. and Devereux, J., eds., M Stockton Press, New York, 1991). While there exists a number of methods to measure identity between two polynucleotide or polypeptides, the term "identity" is well known to skilled artisans (Carillo, H. & Lipton, D., *SIAM J Applied Math* 48:1073 (1988)).

As used herein, homologous (with respect to nucleic acid and/or amino acid sequences) means about greater than or equal to 25% sequence homology, typically greater than or equal to 25%, 40%, 50%, 60%, 70%, 80%, 85%, 90% or 95% sequence homology; the precise percentage can be specified if necessary. For purposes herein the terms "homology" and "identity" are often used interchangeably, unless otherwise indicated. In general, for determination of the percentage homology or identity, sequences are aligned so that the highest order match is obtained (see, e.g.: *Computational Molecular Biology*, Lesk, A. M., ed., Oxford University Press, New York, 1988; *Biocomputing: Informatics and Genome Projects*, Smith, D. W., ed., Academic Press, New York, 1993; *Computer Analysis of Sequence Data*, Part I, Griffin, A. M., and Griffin, H. G., eds., Humana Press, New Jersey, 1994; *Sequence Analysis in Molecular Biology*, von Heinje, G., Academic Press, 1987; and *Sequence Analysis Primer*, Gribskov, M. and Devereux, J., eds., M Stockton Press, New York, 1991; Carillo et al (1988) *SIAM J Applied Math* 48:1073). By sequence homology, the number of conserved amino acids is determined by standard alignment algorithms programs, and can be used with default gap penalties established by each supplier. Substantially homologous nucleic acid molecules hybridize typically at moderate stringency or at high stringency all along the length of the nucleic acid of interest. Also contemplated are nucleic acid molecules that contain degenerate codons in place of codons in the hybridizing nucleic acid molecule.

Whether any two molecules have nucleotide sequences or amino acid sequences that are at least 60%, 70%, 80%, 85%, 90%, 95%, 96%, 97%, 98% or 99% "identical" or "homologous" can be determined using known computer algorithms such as the "FASTA" program, using for example, the default parameters as in Pearson et al (1988) *Proc. Natl. Acad. Sci. USA* 85:2444 (other programs include the GCG program package (Devereux, J., et al, *Nucleic Acids Research* 12(I): 387 (1984)), BLASTP, BLASTN, FASTA (Atschul, S.F., et al., *J Molec Biol* 215:403 (1990)); Guide to Huge Computers, Martin J. Bishop, ed., Academic Press, San Diego, 1994, and Carillo et al. (1988) *SIAM J Applied Math* 48:1073). For example, the BLAST function of the National Center for Biotechnology Information database can be used to determine identity. Other commercially or publicly available programs include, DNAStar "MegAlign" program (Madison, Wis.) and the University of Wisconsin Genetics Computer Group (UWG) "Gap" program (Madison Wis.). Percent homology or identity of proteins and/or nucleic acid molecules can be determined, for example, by comparing sequence information using a GAP computer program (e.g., Needleman et al. (1970) *J. Mol. Biol.* 48:443, as revised by Smith and Waterman (1981) *Adv. Appl. Math.* 2:482). Briefly, the GAP program defines similarity as the number of aligned symbols (i.e., nucleotides or amino acids), which are similar, divided by the total number of symbols in the shorter of the two sequences. Default parameters for the GAP program can include: (1) a unary comparison matrix (containing a value of 1 for identities and 0 for non-identities) and the weighted comparison matrix of Gribskov et al. (1986) *Nucl. Acids Res.* 14:6745, as described by Schwartz and Dayhoff, eds., *ATLAS OF PROTEIN SEQUENCE AND STRUCTURE*, National Biomedical Research Foundation, pp. 353-358 (1979); (2) a penalty of 3.0 for each gap and an additional 0.10 penalty for each symbol in each gap; and (3) no penalty for end gaps.

Therefore, as used herein, the term "identity" or "homology" represents a comparison between a test and a reference polypeptide or polynucleotide. As used herein, the term at least "90% identical to" refers to percent identities from 90 to 99.99 relative to the reference nucleic acid or amino acid sequence of the polypeptide. Identity at a level of 90% or more is indicative of the fact that, assuming for exemplification purposes a test and reference polypeptide length of 100 amino acids are compared, no more than 10% (i.e., 10 out of 100) of the amino acids in the test polypeptide differs from that of the reference polypeptide. Similar comparisons can be made between test and reference polynucleotides. Such differences can be represented as point mutations randomly distributed over the entire length of a polypeptide or they can be clustered in one or more locations of varying length up to the maximum allowable, e.g. 10/100 amino acid difference (approximately 90% identity). Differences are defined as nucleic acid or amino acid substitutions, insertions or deletions. At the level of homologies or identities above about 85-90%, the result can be independent of the program and gap parameters set; such high levels of identity can be assessed readily, often by manual alignment without relying on software.

As used herein, a polypeptide comprising a specified percentage of amino acids set forth in a reference polypeptide refers to the proportion of contiguous identical amino acids shared between a polypeptide and a reference polypeptide. For example, an isoform that comprises 70% of the amino acids set forth in a reference polypeptide having a sequence of amino acids set forth in SEQ ID NO:XX, which recites 147 amino acids, means that the reference polypeptide contains at least 103 contiguous amino acids set forth in the amino acid sequence of SEQ ID NO:XX.

As used herein, an aligned sequence refers to the use of homology (similarity and/or identity) to align corresponding positions in a sequence of nucleotides or amino acids. Typically, two or more sequences that are related by 50% or more identity are aligned. An aligned set of sequences refers to 2 or more sequences that are aligned at corresponding positions and can include aligning sequences derived from RNAs, such as ESTs and other cDNAs, aligned with genomic DNA sequence.

As used herein, "primer" refers to a nucleic acid molecule that can act as a point of initiation of template-directed DNA synthesis under appropriate conditions (e.g., in the presence of four different nucleoside triphosphates and a polymerization agent, such as DNA polymerase, RNA polymerase or reverse transcriptase) in an appropriate buffer and at a suitable temperature. It will be appreciated that a certain nucleic acid molecules can serve as a "probe" and as a "primer." A primer, however, has a 3' hydroxyl group for extension. A primer can be used in a variety of methods, including, for example, polymerase chain reaction (PCR), reverse-transcriptase (RT)-PCR, RNA PCR, LCR, multiplex PCR, panhandle PCR, capture PCR, expression PCR, 3' and 5' RACE, in situ PCR, ligation-mediated PCR and other amplification protocols.

As used herein, "primer pair" refers to a set of primers that includes a 5' (upstream) primer that hybridizes with the 5' end of a sequence to be amplified (e.g. by PCR) and a 3' (downstream) primer that hybridizes with the complement of the 3' end of the sequence to be amplified.

As used herein, "specifically hybridizes" refers to annealing, by complementary base-pairing, of a nucleic acid molecule (e.g. an oligonucleotide) to a target nucleic acid molecule. Those of skill in the art are familiar with in vitro and in vivo parameters that affect specific hybridization, such as length and composition of the particular molecule. Parameters particularly relevant to in vitro hybridization further include annealing and washing temperature, buffer composition and salt concentration. Exemplary washing conditions for removing non-specifically bound nucleic acid molecules at high stringency are 0.1×SSPE, 0.1% SDS, 65° C., and at medium stringency are 0.2×SSPE, 0.1% SDS, 50° C. Equivalent stringency conditions are known in the art. The skilled person can readily adjust these parameters to achieve specific hybridization of a nucleic acid molecule to a target nucleic acid molecule appropriate for a particular application.

As used herein, substantially identical to a product means sufficiently similar so that the property of interest is sufficiently unchanged so that the substantially identical product can be used in place of the product.

As used herein, it also is understood that the terms "substantially identical" or "similar" varies with the context as understood by those skilled in the relevant art.

As used herein, an allelic variant or allelic variation references any of two or more alternative forms of a gene occupying the same chromosomal locus. Allelic variation arises naturally through mutation, and can result in phenotypic polymorphism within populations. Gene mutations can be silent (no change in the encoded polypeptide) or can encode polypeptides having altered amino acid sequence. The term "allelic variant" also is used herein to denote a protein encoded by an allelic variant of a gene. Typically the reference form of the gene encodes a wildtype form and/or predominant form of a polypeptide from a population or single reference member of a species. Typically, allelic variants, which include variants between and among species typically have at least 80%, 90% or greater amino acid identity with a wildtype and/or predominant form from the same species; the degree of identity depends upon the gene and whether comparison is interspecies or intraspecies. Generally, intraspecies allelic variants have at least about 80%, 85%, 90% or 95% identity or greater with a wildtype and/or predominant form, including 96%, 97%, 98%, 99% or greater identity with a wildtype and/or predominant form of a polypeptide. Reference to an allelic variant herein generally refers to variations n proteins among members of the same species.

As used herein, "allele," which is used interchangeably herein with "allelic variant" refers to alternative forms of a gene or portions thereof. Alleles occupy the same locus or position on homologous chromosomes. When a subject has two identical alleles of a gene, the subject is said to be homozygous for that gene or allele. When a subject has two different alleles of a gene, the subject is said to be heterozygous for the gene. Alleles of a specific gene can differ from each other in a single nucleotide or several nucleotides, and can include substitutions, deletions and insertions of nucleotides. An allele of a gene also can be a form of a gene containing a mutation.

As used herein, species variants refer to variants in polypeptides among different species, including different mammalian species, such as mouse and human.

As used herein, a splice variant refers to a variant produced by differential processing of a primary transcript of genomic DNA that results in more than one type of mRNA.

As used herein, the term promoter means a portion of a gene containing DNA sequences that provide for the binding of RNA polymerase and initiation of transcription. Promoter sequences are commonly, but not always, found in the 5' non-coding region of genes.

As used herein, isolated or purified polypeptide or protein or biologically-active portion thereof is substantially free of cellular material or other contaminating proteins from the cell or tissue from which the protein is derived, or substantially free from chemical precursors or other chemicals when chemically synthesized. Preparations can be determined to be substantially free if they appear free of readily detectable impurities as determined by standard methods of analysis, such as thin layer chromatography (TLC), gel electrophoresis and high performance liquid chromatography (HPLC), used by those of skill in the art to assess such purity, or sufficiently pure such that further purification does not detectably alter the physical and chemical properties, such as enzymatic and biological activities, of the substance. Methods for purification of the compounds to produce substantially chemically pure compounds are known to those of skill in the art. A substantially chemically pure compound, however, can be a mixture of stereoisomers. In such instances, further purification might increase the specific activity of the compound.

The term substantially free of cellular material includes preparations of proteins in which the protein is separated from cellular components of the cells from which it is isolated or recombinantly-produced. In one embodiment, the term substantially free of cellular material includes preparations of protease proteins having less that about 30% (by dry weight) of non-protease proteins (also referred to herein as a contaminating protein), generally less than about 20% of non-protease proteins or 10% of non-protease proteins or less that about 5% of non-protease proteins. When the protease protein or active portion thereof is recombinantly produced, it also is substantially free of culture medium, i.e., culture medium represents less than about or at 20%, 10% or 5% of the volume of the protease protein preparation.

As used herein, the term substantially free of chemical precursors or other chemicals includes preparations of protease proteins in which the protein is separated from chemical precursors or other chemicals that are involved in the synthesis of the protein. The term includes preparations of protease proteins having less than about 30% (by dry weight), 20%, 10%, 5% or less of chemical precursors or non-protease chemicals or components.

As used herein, synthetic, with reference to, for example, a synthetic nucleic acid molecule or a synthetic gene or a synthetic peptide refers to a nucleic acid molecule or polypeptide molecule that is produced by recombinant methods and/or by chemical synthesis methods.

As used herein, production by recombinant means by using recombinant DNA methods means the use of the well known methods of molecular biology for expressing proteins encoded by cloned DNA.

As used herein, vector (or plasmid) refers to discrete elements that are used to introduce a heterologous nucleic acid into cells for either expression or replication thereof. The vectors typically remain episomal, but can be designed to effect integration of a gene or portion thereof into a chromosome of the genome. Also contemplated are vectors that are artificial chromosomes, such as yeast artificial chromosomes and mammalian artificial chromosomes. Selection and use of such vehicles are well known to those of skill in the art.

As used herein, an expression vector includes vectors capable of expressing DNA that is operatively linked with regulatory sequences, such as promoter regions, that are capable of effecting expression of such DNA fragments. Such additional segments can include promoter and terminator sequences, and optionally can include one or more origins of replication, one or more selectable markers, an enhancer, a polyadenylation signal, and the like. Expression vectors are generally derived from plasmid or viral DNA, or can contain elements of both. Thus, an expression vector refers to a recombinant DNA or RNA construct, such as a plasmid, a phage, recombinant virus or other vector that, upon introduction into an appropriate host cell, results in expression of the cloned DNA. Appropriate expression vectors are well known to those of skill in the art and include those that are replicable in eukaryotic cells and/or prokaryotic cells and those that remain episomal or those which integrate into the host cell genome.

As used herein, vector also includes "virus vectors" or "viral vectors." Viral vectors are engineered viruses that are operatively linked to exogenous genes to transfer (as vehicles or shuttles) the exogenous genes into cells.

As used herein, operably or operatively linked when referring to DNA segments means that the segments are arranged so that they function in concert for their intended purposes, e.g., transcription initiates in the promoter and proceeds through the coding segment to the terminator.

As used herein, biological sample refers to any sample obtained from a living or viral source and includes any cell type or tissue of a subject from which nucleic acid or protein or other macromolecule can be obtained. Biological samples include, but are not limited to, body fluids, such as blood, plasma, serum, cerebrospinal fluid, synovial fluid, urine and sweat, tissue and organ samples from animals and plants. Also included are soil and water samples and other environmental samples, viruses, bacteria, fungi, algae, protozoa and components thereof. Hence bacterial and viral and other contamination of food products and environments can be assessed. The methods herein are practiced using biological samples and in some embodiments, such as for profiling, also can be used for testing any sample.

As used herein, macromolecule refers to any molecule having a molecular weight from the hundreds up to the millions. Macromolecules include peptides, proteins, nucleotides, nucleic acids, and other such molecules that are generally synthesized by biological organisms, but can be prepared synthetically or using recombinant molecular biology methods.

As used herein, the term "biopolymer" is a biological molecule, including macromolecules, composed of two or more monomeric subunits, or derivatives thereof, which are linked by a bond or a macromolecule. A biopolymer can be, for example, a polynucleotide, a polypeptide, a carbohydrate, or a lipid, or derivatives or combinations thereof, for example, a nucleic acid molecule containing a peptide nucleic acid portion or a glycoprotein, respectively. Biopolymers include, but are not limited to, nucleic acids, proteins, polysaccharides, lipids and other macromolecules. Nucleic acids include DNA, RNA, and fragments thereof. Nucleic acids can be derived from genomic DNA, RNA, mitochondrial nucleic acid, chloroplast nucleic acid and other organelles with separate genetic material.

As used herein, a biomolecule is any compound found in nature, or derivatives thereof. Biomolecules include, but are not limited to: oligonucleotides, oligonucleosides, proteins, peptides, amino acids, peptide nucleic acids (PNAs), oligosaccharides and monosaccharides.

As used herein, a biological particle refers to a virus, such as a viral vector or viral capsid with or without packaged nucleic acid, phage, including a phage vector or phage capsid, with or without encapsulated nucleic acid, a single cell, including eukaryotic and prokaryotic cells or fragments thereof, a liposome or micellar agent or other packaging particle, and other such biological materials.

As used herein, a composition refers to any mixture. It can be a solution, a suspension, liquid, powder, a paste, aqueous, non-aqueous or any combination thereof.

As used herein, a combination refers to any association between or among two or more items. The combination can be two or more separate items, such as two compositions or two collections, can be a mixture thereof, such as a single mixture of the two or more items, or any variation thereof.

As used herein, kit refers to a packaged combination, optionally including instructions and/or reagents for their use.

As used herein, fluid refers to any composition that can flow. Fluids thus encompass compositions that are in the form of semi-solids, pastes, solutions, aqueous mixtures, gels, lotions, creams and other such compositions.

As used herein, antigenic means that a polypeptide induce an immune response. Highly antigenic polypeptides are those that reproducibly and predictably induce an immune response.

As used herein, a pharmaceutical effect or therapeutic effect refers to an effect observed upon administration of an agent intended for treatment of a disease or disorder or for amelioration of the symptoms thereof.

As used herein, "disease or disorder" refers to a pathological condition in an organism resulting from cause or condition including, but not limited to, infections, acquired conditions, genetic conditions, and characterized by identifiable symptoms. Diseases and disorders of interest herein are those involving a specific target protein including those mediated by a target protein and those in which a target protein plays a role in the etiology or pathology. Exemplary target proteins and associated diseases and disorders are described elsewhere herein.

As used herein, "treating" a subject with a disease or condition means that the subject's symptoms are partially or totally alleviated, or remain static following treatment. Hence treatment encompasses prophylaxis, therapy and/or cure. Prophylaxis refers to prevention of a potential disease and/or a prevention of worsening of symptoms or progression of a disease. Treatment also encompasses any pharmaceutical use of a modified interferon and compositions provided herein.

As used herein, a therapeutic agent, therapeutic regimen, radioprotectant, or chemotherapeutic mean conventional drugs and drug therapies, including vaccines, which are known to those skilled in the art. Radiotherapeutic agents are well known in the art.

As used herein, treatment means any manner in which the symptoms of a condition, disorder or disease or other indication, are ameliorated or otherwise beneficially altered.

As used herein therapeutic effect means an effect resulting from treatment of a subject that alters, typically improves or ameliorates the symptoms of a disease or condition or that cures a disease or condition. A therapeutically effective amount refers to the amount of a composition, molecule or compound which results in a therapeutic effect following administration to a subject.

As used herein, the term "subject" refers to an animal, including a mammal, such as a human being.

As used herein, a patient refers to a human subject.

As used herein, amelioration of the symptoms of a particular disease or disorder by a treatment, such as by administration of a pharmaceutical composition or other therapeutic, refers to any lessening, whether permanent or temporary, lasting or transient, of the symptoms that can be attributed to or associated with administration of the composition or therapeutic.

As used herein, prevention or prophylaxis refers to methods in which the risk of developing disease or condition is reduced.

As used herein, an effective amount is the quantity of a therapeutic agent necessary for preventing, curing, ameliorating, arresting or partially arresting a symptom of a disease or disorder.

As used herein, administration refers to any method in which an antibody or protion thereof is contacted with its target protein. Administration can be effected in vivo or ex vivo or in vitro. For example, for ex vivo administration a body fluid, such as blood, is removed from a subject and contacted outside the body with the antibody or portion thereof. For in vivo administration, the antibody or portion thereof can be introduced into the body, such as by local, topical, systemic and/or other route of introduction. In vitro administration encompasses methods, such as cell culture methods.

As used herein, unit dose form refers to physically discrete units suitable for human and animal subjects and packaged individually as is known in the art.

As used herein, a single dosage formulation refers to a formulation for direct administration.

As used herein, an "article of manufacture" is a product that is made and sold. As used throughout this application, the term is intended to encompass compiled germline antibodies or antibodies obtained therefrom contained in articles of packaging.

As used herein, fluid refers to any composition that can flow. Fluids thus encompass compositions that are in the form of semi-solids, pastes, solutions, aqueous mixtures, gels, lotions, creams and other such compositions.

As used herein, animal includes any animal, such as, but are not limited to primates including humans, gorillas and monkeys; rodents, such as mice and rats; fowl, such as chickens; ruminants, such as goats, cows, deer, sheep; mammals, such as pigs and other animals. Non-human animals exclude humans as the contemplated animal. The germline segments, and resulting antibodies, provided herein are from any source, animal, plant, prokaryotic and fungal. Most germline segments, and resulting antibodies, are of animal origin, including mammalian origin.

As used herein, a control refers to a sample that is substantially identical to the test sample, except that it is not treated with a test parameter, or, if it is a sample plasma sample, it can be from a normal volunteer not affected with the condition of interest. A control also can be an internal control.

As used herein, the singular forms "a," "an" and "the" include plural referents unless the context clearly dictates otherwise. Thus, for example, reference to compound, comprising "an extracellular domain" includes compounds with one or a plurality of extracellular domains.

As used herein, ranges and amounts can be expressed as "about" a particular value or range. About also includes the exact amount. Hence "about 5 bases" means "about 5 bases" and also "5 bases."

As used herein, "optional" or "optionally" means that the subsequently described event or circumstance does or does not occur, and that the description includes instances where said event or circumstance occurs and instances where it does not. For example, an optionally substituted group means that the group is unsubstituted or is substituted.

As used herein, the abbreviations for any protective groups, amino acids and other compounds, are, unless indicated otherwise, in accord with their common usage, recognized abbreviations, or the IUPAC-IUB Commission on Biochemical Nomenclature (see, (1972) *Biochem.* 11:1726).

B. DLL4

Provided herein are antibodies or antigen-binding antibody fragments that specifically bind to human Delta-like ligand 4 (DLL4).

1. Structure

DLL4 (set forth in SEQ ID NO:114; and encoded by a sequence of nucleotides set forth in SEQ ID NO:113) is a transmembrane protein ligand for Notch transmembrane receptors. The extracellular region contains 8 EGF-like repeats, as well as a DSL domain that is conserved among all Notch ligands and is necessary for receptor binding. The protein also contains a transmembrane region, and a cytoplasmic tail lacking any catalytic motifs. Human DLL4 is a 685 amino acid protein and contains the following domains corresponding to amino acids set forth in SEQ ID NO:114: signal peptide (amino acids 1-25); MNNL (SEQ ID NO: 905) (amino acids 26-92); DSL (amino acids 155-217); EGF-Like 1 (EGF1; amino acids 221-251); EGF-Like 2 (EGF2; amino acids 252-282); EGF-Like 3 (EGF3; amino acids 284-322); EGF-Like 4 (EGF4; amino acids 324-360); EGF-Like 5 (EGF5; amino acids 366-400); EGF-Like 6 (EGF6; amino acids 402-438); EGF-Like 7 (EGF7; amino acids 440-476); EGF-Like 8 (EGF8; amino acids 480-518); transmembrane (amino acids 529-551); and cytoplasmic domain (amino acids 553-685).

2. Expression

DLL4 is expressed widely in a variety of tissues, but its expression is predominantly localized to the vasculature. It is required for normal vascular development and is expressed on tumor vessels. It is upregulated in blood vessels during tumor angiogenesis and expression is dependent on VEGF signaling. DLL4 also is expressed on activated macrophages exposed to proinflammatory stimuli such as lipopolysaccharide, interleukin-1β, Toll-like receptor 4 ligands and other proinflammatory stimuli and it's signaling through the Notch pathway plays a role in inflammatory states characterized by macrophage activation (Fung et al. (2007) *Circulation*, 115: 2948-2956).

3. Function

DLL4 binds to Notch receptors. The evolutionary conserved Notch pathway is a key regulator of many developmental processes as well as postnatal self-renewing organ systems. From invertebrates to mammals, Notch signaling guides cells through a myriad of cell fate decisions and influences proliferation, differentiation and apoptosis (Miele and Osborne (1999) *J Cell Physiol.*, 181:393-409). The Notch family is made up of structurally conserved cell surface receptors that are activated by membrane bound ligands of the DSL gene family (named for Delta and Serrate from *Drosophila* and Lag-2 from *C. elegans*). Mammals have four receptors (Notch 1, Notch 2, Notch 3 and Notch 4) and five ligands (Jag 1, Jag 2, DLL1, DLL3, and DLL4). Upon activation by ligands presented on neighboring cells, Notch receptors undergo successive proteolytic cleavages; an extracellular cleavage mediated by an ADAM protease and a cleavage within the trnamembrane domain mediated by gamma secretase. This leads to the release of the Notch Intra-Cellular Domain (NICD), which translocates into the nucleus and forms a transcriptional complex with the DNA binding protein, RBP-Jk (also known as CSL for CBF1/Su(H)/Lag-1) and other transcriptional cofactors. The primary target genes of Notch activation include the HES (Hairy/Enhance of Split) gene family and HES-related genes (Hey, CHF, HRT, HESR), which in turn regulate the downstream transcriptional effectors in a tissue and cell-type specific manner (Iso et al. (2003) *J Cell Physiol.*, 194:237-255; Li and Harris (2005) *Cancer Cell*, 8:1-3).

Signaling by Notch receptors implicate a variety of cellular processes including, but not limited to, the normal maintenance and leukemic transformation of hematopoietic stem cells (HSCs; Kopper & Hajdu (2004) *Pathol. Oncol. Res.*, 10:69-73); maintenance of neural stem cells including in their normal maintenance as well as in brain cancers (Kopper & Hajdu (2004) *Pathol. Oncol. Res.*, 10:69-73; Purow et al. (2005) *Cancer Res.* 65:2353-63; Hallahan et al., (2004) *Cancer Res.* 64:7794-800); generation of a number of human cancers including in lymphoblastic leukemia/lymphoma (Ellisen et al. (1991) *Cell*, 66:649-61; Robey et al. (1996) *Cell*, 87:483-92; Pear et al. (1996) *J. Exp. Med.* 183:2283-91; Yan et al. (2001) *Blood* 98:3793-9; Bellavia et al. (2000) *EMBO J.* 19:3337-48; Pear & Aster (2004) *Curr. Opin. Hematol.*, 11:416-33); breast cancer (Gallahan & Callahan (1987) *J. Virol.*, 61:66-74; Brennan & Brown (2003) *Breast Cancer Res.*, 5:69; Politi et al. (2004) *Semin. Cancer Biol.*, 14:341-7; Weijzen et al. (2002) *Nat. Med.*, 8:979-86; Parr et al. (2004) *Int. J. Mol. Med.*, 14:779-86); cervical cancer (Zagouras et al. (1995) *PNAS*, 92:6414-8); renal cell carcinomas (Rae et al (2000) *Int. J. Cancer*, 88:726-32); head and neck squamous cell carcinomas (Leethanakul et al (2000) *Oncogene*, 19:3220-4); endometrial cancers (Suzuki et al. (2000) *Int. J. Oncol.*, 17:1131-9); and neuroblastomas (van Limpt et al. (2000) *Med. Pediatr. Oncol.*, 35:554-8).

The Notch pathway also is involved in multiple aspects of vascular development including proliferation, migration, smooth muscle differentiation, angiogenesis and arterial-venous differentiation (Iso et al. (2003) *Arterioscler. Thromb. Vasc. Biol.* 23: 543).

Specifically, DLL4 activates Notch-1 (Uniprot accession No. P46531; SEQ ID NO:899) and Notch-4 receptors (Uniprot accession No. Q99466; SEQ ID NO:900). DLL4 is involved in stem cell self-renewal and in stem cell growth and differentiation in many lineages and tumor types (Wilson and Radtke (2006), *FEBS Lett.*, 580:2860-8). DLL4 also is involved in vascular development. Deletion of a single allele of DLL4 results in embryonic lethality caused by defects in development of the vasculature (Duarte et al. (2004) *Genes Dev.*, 18:2474-8; Gale et al. (2004) *PNAS*, 101:15949-54; Krebs et al. (2004), *Genes Dev.*, 18:2469-73).

DLL4-mediated Notch signaling is involved in embryonic vascular development. For example, DLL4 expression in growing endothelial cells in the neonatal retina indicates a role for DLL4 in retinal vascular development. DLL4 also is involved in tumor angiogenesis. Down-regulation of DLL4 expression inhibits VEGF-mediated endothelial cell proliferation, migration, and network formation (Patel et al. (2005) *Cancer Res.* 65:8690-7). Yet, DLL4 expression on angiogenic endothelial cells acts as a negative regulator of tumor angiogenesis and vascular growth. (Ridgway et al. (2006) *Nature*, 444:1083; Noguera-Troise et al. (2006) *Nature*, 444:1032). Although blockage of DLL4 is associated with increased angiogenesis characterized by sprouting and branching of blood vessels, it also is associated with a decrease in vessel function, thereby resulting in decreased tumor growth (Ridgway et al. (2006) *Nature*, 444:1083; Noguera-Troise et al. (2006) *Nature*, 444:1032). Accordingly, DLL4 function is associated with deregulated angiogenesis by uncoupling of tumor growth from tumor vascular density. Thus, blocking DLL4 signaling effectively reduces tumor growth by disrupting productive angiogenesis. The inhibitory effect of DLL4 on angiogenesis is distinct from traditional antiangiogenic therapies by causing hyperproliferation of tumor vessels that leads to a reduction in tumor growth (Sainson and Harris (2007) *Trend Mol. Med.,* 13:389-395; Thurston et al. (2007), *Nat Rev. Cancer,* 7:327-331). Blocking DLL4 also inhibits tumor growth and tumorigenic cell frequency independent of an angiogenic mechanism by decreasing tumor growth, delaying tumor recurrence after chemotherapeutic treatment and decreasing the percentage of tumorogenic cells (Hoey et al. (2009) *Cell Stem Cell,* 5:168-177). Blocking DLL4 activity is associated with decreased gene expression of HES1 (Hoey et al. (2009) *Cell Stem Cell,* 5:168-177).

C. Antibodies

Provided herein are antibodies that modulate the activity of DLL4 and therefore can be used in the treatment of diseases or conditions associated with expression or activity of DLL4. Such antibodies include those that have a VH chain and a VL chain sufficient to form an antigen binding site. The antibodies further can contain a constant region. Anti-DLL4 antibodies include full-length antibodies and antigen binding antibody fragments, whereby the fragment or portion of the antibody is sufficient to form an antigen binding site. Included among fragments or portions of antibody members in the libraries provided herein are a Fab, Fab', F(ab')$_2$, single-chain Fvs (scFv), Fv, dsFv, diabody, Fd and Fd' fragments, Fab fragments, Fd fragments, scFv fragments, or a scFab fragments. Exemplary of such antibodies are Fab antibodies. Antibodies provided herein include isolated antibodies.

Antibodies or fragments thereof provided herein bind DLL4. The antibodies include those that have a binding affinity for DLL4 that is or is about $10^{-6}$ M, $10^{-7}$ M, $10^{-8}$ M, $10^{-9}$ M, $10^{-10}$ M, $10^{-11}$ M, $10^{-12}$ M or lower, in particular any that have a nanomolar or sub-nanomolar binding affinity, for example, that is or is about $1\times10^{-9}$ M, $2\times10^{-9}$ M, $3\times10^{-9}$ M, $4\times10^{-9}$ M, $5\times10^{-9}$ M, $6\times10^{-9}$ M, $7\times10^{-9}$ M, $8\times10^{-9}$ M, $9\times10^{-9}$ M, $1\times10^{-10}$ M, $2\times10^{-10}$ M, $3\times10^{-10}$ M, $4\times10^{-10}$ M, $5\times10^{-10}$ M, $10^{-11}$ M, $10^{-12}$ M or lower.

In some embodiments, the antibody specifically binds to DLL4. In other examples, the antibody has dual- or multi-specificity for DLL4 and one or more other target proteins. Hence, anti-DLL4 antibodies provided herein are bispecific or multispecific having binding specificity for at least two different antigens. For example, an anti-DLL4 antibody can exhibit binding specificity for DLL4 and at least one other target protein that is a cytokine receptor, a receptor kinase, a receptor phosphatase, a receptor involved in cell-cell interactions or a cellular adhesion molecule. For example, an anti-DLL4 antibody also can exhibit binding specificity for a target protein including, but not limited to, a VEGFR-1, VEGFR-2, VEGFR-3, a epidermal growth factor receptor (EGFR), ErbB-2, ErbB-3, IGF-R1, C-Met, TNF-R1, TNF-R2, BTLA, HVEM, LT-βR, CD20, CD3, CD25, NOTCH, DLL4, DDR1 (discoidin domain receptor), KIT (receptor for c-kit), FGFR1, FGFR2, FGFR4 (fibroblast growth factor receptors 1, 2 and 4), RON (recepteur d'origine nantais; also known as macrophage stimulating 1 receptor), TEK (endothelial-specific receptor tyrosine kinase), TIE (tyrosine kinase with immunoglobulin and epimermal growth factor homology domains receptor), CSF1R (colngly stimulating factor 1 receptor), PDGFRB (platelet-derived growth factor receptor B), EPHA1, EPHA2, EPHB1 (erythropoietin-producing hepatocellular receptor A1, A2 and B1), (recepteur d'origine nantais; also known as macrophage stimulating 1 receptor), G-CSF-R, GM-CSF-R, EPO-R, a cadherin (e.g. p-cadherin), an integrin, CD52 and CD44, a VEGF-A, VEGF-B, VEGF-C, VEGF-D, PlGF, EGF, HGF, TNF-α, LIGHT, lymphotoxin (LT), IgE, G-CSF, GM-CSF and EPO. Generally, when exhibiting dual- or multi-specific binding an antibody provided herein has a binding affinity for each of the target antigens that is or is about $10^{-6}$ M, $10^{-7}$ M, $10^{-8}$ M, $10^{-9}$ M, $10^{-10}$ M, $10^{-11}$ M, $10^{-12}$ M or lower.

In some embodiments, the antibody specifically binds to the DLL4 extracellular domain (ECD). For example, an anti-DLL4 antibody provided herein binds to an epitope in any one or more of the domains within the ECD, including, but not limited an epitope within the MNNL, DSL, EGF1, EGF2, EGF3, EGF4, EGF5, EGF6, EGF7 or EGF8 domain. In particular, an anti-DLL4 antibody provided herein binds to an epitope within the ECD that is between the EGF2 to EGF8 region, for example, within amino acid residues 252 to 524 of DLL4 set forth in SEQ ID NO:114. In one examples, anti-DLL4 antibodies provided herein bind to an epitope within the ECD that is within EGF2 corresponding to an epitope within or between amino acids 252 to 280 of DLL4 set forth in SEQ ID NO:114. In another example, anti-DLL4 antibodies provided herein bind to an epitope within or between amino acid residues 283 to 360 of DLL4 set forth in SEQ ID NO:114 in the EGF3 to EGF4 region.

Anti-DLL4 antibody provided herein includes those that are agonists, mimicking the normal effects of receptor binding, or antagonists, inhibiting the normal effects of receptor binding. Of particular interest are antibodies which bind to the target protein and modulate intracellular signalling. In some embodiments, an antibody reduces, inhibits, and/or blocks DLL4 activity in vivo and/or in vitro. In some embodiments, the antibody competes for binding with DLL4-ligand (reduces and/or blocks Notch receptor binding to DLL4). In some embodiments, the antibodies can modulate one or more aspects of DLL4-associated effects, including but not limited to any one or more of reduction or blocking of Notch receptor activation, reduction or blocking of Notch receptor downstream molecular signaling, disruption or blocking of Notch receptor binding to DLL4, and/or promotion of endothelial cell proliferation, and/or inhibition of endothelial cell differentiation, and/or inhibition of arterial differentiation, and/or inhibition of tumor vascular perfusion, and/or treatment and/or prevention of a tumor, cell proliferative disorder or a cancer; and/or treatment or prevention of a disorder associated with DLL4 expression and/or activity and/or treatment or prevention of a disorder associated with Notch receptor expression and/or activity. Exemplary of activities modulated by anti-DLL4 antibodies include inhibiting angiogenesis, tumor growth and/or tumorigenic cell frequency.

Anti-DLL4 antibodies provided herein include germline-derived anti-DLL4 antibodies, or modified antibodies thereof. Anti-DLL4 antibodies provided herein also include those that contain one or more complementary determining regions (CDRs) involved in binding to DLL4.

1. Germline-Derived Anti-DLL4 Antibodies

Anti-DLL4 antibodies provided herein include those that are derived from germline segments of human origin. Exemplary antibody germline sources include but are not limited to databases at the National Center for Biotechnology Information (NCBI), the international ImMunoGeneTics information System® (IMGT), the Kabat database and the Tomlinson's VBase database (Lefranc (2003) *Nucleic Acids Res.,* 31:307-310; Martin et al., Bioinformatics Tools for Antibody Engineering in Handbook of Therapeutic Antibodies, Wiley-VCH (2007), pp. 104-107). Variable gene segments include $V_H$, $D_H$, $J_H$, $V_\kappa$, $J_\kappa$, $V_\lambda$ and $J_\lambda$. Hence, the heavy chain of an anti-DLL4 antibody provided herein includes amino acids encoded by a $V_H$, $D_H$, and $J_H$ germline segment. Table 3 lists exemplary human heavy chain germline gene segments. The light chain of an anti-DLL4 antibody provided herein includes amino acids encoded by a $V_\kappa$, $J_\kappa$, $V_\lambda$ and $J_\lambda$ germline segment. Tables 4 and 5 list exemplary human light chain germline gene segments.

For purposes herein, germline segments are listed using IMGT gene names and definitions previously approved by the Human Genome Organization (HUGO) nomenclature committee. The segments are named using IMGT nomenclature, whereby the first three letters indicate the locus (IGH, IGK or IGL), the fourth letter represents the gene (e.g., V for V-gene, D for D-gene, J for J-gene), the fifth position indicates the number of the subgroup, followed by a hyphen indicating the gene number classification. For alleles, the IMGT name is followed by an asterisk and a two figure number. Any desired naming convention can be used to identify antibody germline segments. For purposes herein when describing the variable heavy or light chain nucleic acid sequence derived from germline segments (see e.g., Tables 3-5), VH germline segments are named using IMGT nomenclature without any allele identified; VK germline segments are named using Zachau nomenclature; and VL germline segments are identified using Kawasaki nomenclature. DH, JH, JK and JL germline segments are named using IMGT nomenclature.

TABLE 3

| Human Heavy Chain Germline V Genes | | | | | | | |
|---|---|---|---|---|---|---|---|
| V Segments | | | | D Segments | | J Segments | |
| SEQ ID NO | IMGT with alleles | IMGT | | SEQ ID NO | IMGT with alleles | SEQ ID NO | IMGT with alleles |
| 574 | IGHV1-18*01 | VH1-18 | | 690 | IGHD2-15*01 | 719 | IGHJ1*01 |
| 575 | IGHV1-18*02 | | | 691 | IGHD2-2*01 | 720 | IGHJ2*01 |
| 576 | IGHV1-2*01 | | | 692 | IGHD2-2*02 | 721 | IGHJ3*01 |
| 577 | IGHV1-2*02 | VH1-2 | | 693 | IGHD2-2*03 | 722 | IGHJ4*01 |
| 578 | IGHV1-2*03 | | | 694 | IGHD2-21*01 | 723 | IGHJ4*02 |
| 579 | IGHV1-2*04 | | | 695 | IGHD2-21*02 | 724 | IGHJ4*03 |
| 580 | IGHV1-24*01 | VH1-24 | | 696 | IGHD2-8*01 | 725 | IGHJ6*01 |
| 581 | IGHV1-3*01 | | | 697 | IGHD2-8*02 | 726 | IGHJ6*02 |
| 582 | IGHV1-3*02 | VH1-3 | | 698 | IGHD3-10*01 | 727 | IGHJ6*03 |
| 583 | IGHV1-45*01 | | | 699 | IGHD3-10*02 | 728 | IGHJ6*04 |
| 584 | IGHV1-45*02 | VH1-45 | | 700 | IGHD3-16*01 | | |
| 585 | IGHV1-45*03 | | | 701 | IGHD3-16*02 | | |
| 586 | IGHV1-46*01 | VH1-46 | | 702 | IGHD3-22*01 | | |
| 587 | IGHV1-46*02 | | | 703 | IGHD3-3*01 | | |
| 588 | IGHV1-46*03 | | | 704 | IGHD3-3*02 | | |
| 589 | IGHV1-58*01 | | | 705 | IGHD3-9*01 | | |
| 590 | IGHV1-58*02 | VH1-58 | | 706 | IGHD4-11*01 | | |
| 591 | IGHV1-69*01 | | | 707 | IGHD4-17*01 | | |
| 592 | IGHV1-69*02 | | | 708 | IGHD4-23*01 | | |
| 593 | IGHV1-69*03 | | | 709 | IGHD4-4*01 | | |
| 594 | IGHV1-69*04 | | | 710 | IGHD5-12*01 | | |
| 595 | IGHV1-69*05 | | | 711 | IGHD5-18*01 | | |
| 596 | IGHV1-69*06 | VH1-69 | | 712 | IGHD5-24*01 | | |
| 597 | IGHV1-69*07 | | | 713 | IGHD5-5*01 | | |
| 598 | IGHV1-69*08 | | | 714 | IGHD6-13*01 | | |
| 599 | IGHV1-69*09 | | | 715 | IGHD6-19*01 | | |
| 600 | IGHV1-69*10 | | | 716 | IGHD6-25*01 | | |
| 601 | IGHV1-69*11 | | | 717 | IGHD6-6*01 | | |
| 602 | IGHV1-69*12 | | | 718 | IGHD7-27*01 | | |
| 603 | IGHV1-69*13 | | | | | | |
| 604 | IGHV1-8*01 | VH1-8 | | | | | |
| 605 | IGHV1-c*01 | | | | | | |
| 606 | IGHV1-f*01 | | | | | | |
| 607 | IGHV1-f*02 | | | | | | |
| 608 | IGHV4-28*01 | VH4-28 | | | | | |
| 609 | IGHV4-28*02 | | | | | | |
| 610 | IGHV4-28*03 | | | | | | |
| 611 | IGHV4-28*04 | | | | | | |
| 612 | IGHV4-28*05 | | | | | | |
| 613 | IGHV4-30-2*01 | | | | | | |
| 614 | IGHV4-30-2*02 | | | | | | |
| 615 | IGHV4-30-2*03 | | | | | | |
| 616 | IGHV4-30-2*04 | | | | | | |
| 617 | IGHV4-30-4*01 | | | | | | |
| 618 | IGHV4-30-4*02 | | | | | | |
| 619 | IGHV4-30-4*03 | | | | | | |
| 620 | IGHV4-30-4*04 | | | | | | |
| 621 | IGHV4-30-4*05 | | | | | | |
| 622 | IGHV4-30-4*06 | | | | | | |
| 623 | IGHV4-31*01 | | | | | | |
| 624 | IGHV4-31*02 | VH4-31 | | | | | |
| 625 | IGHV4-31*03 | | | | | | |
| 626 | IGHV4-31*04 | | | | | | |
| 627 | IGHV4-31*05 | | | | | | |
| 628 | IGHV4-31*06 | | | | | | |
| 629 | IGHV4-31*07 | | | | | | |
| 630 | IGHV4-31*08 | | | | | | |

TABLE 3-continued

Human Heavy Chain Germline V Genes

| V Segments | | D Segments | | J Segments | |
|---|---|---|---|---|---|
| SEQ ID NO | IMGT with alleles | IMGT | SEQ ID NO | IMGT with alleles | SEQ ID NO | IMGT with alleles |
| 631 | IGHV4-31*09 | | | | |
| 632 | IGHV4-31*10 | | | | |
| 633 | IGHV4-34*01 | V4-34 | | | |
| 634 | IGHV4-34*02 | | | | |
| 635 | IGHV4-34*03 | | | | |
| 636 | IGHV4-34*04 | | | | |
| 637 | IGHV4-34*05 | | | | |
| 638 | IGHV4-34*06 | | | | |
| 639 | IGHV4-34*07 | | | | |
| 640 | IGHV4-34*08 | | | | |
| 641 | IGHV4-34*09 | | | | |
| 642 | IGHV4-34*10 | | | | |
| 643 | IGHV4-34*11 | | | | |
| 644 | IGHV4-34*12 | | | | |
| 645 | IGHV4-34*13 | | | | |
| 646 | IGHV4-39*01 | VH4-39 | | | |
| 647 | IGHV4-39*02 | | | | |
| 648 | IGHV4-39*03 | | | | |
| 649 | IGHV4-39*04 | | | | |
| 650 | IGHV4-39*05 | | | | |
| 651 | IGHV4-39*06 | | | | |
| 652 | IGHV4-39*07 | | | | |
| 653 | IGHV4-4*01 | | | | |
| 654 | IGHV4-4*02 | | | | |
| 655 | IGHV4-4*03 | | | | |
| 656 | IGHV4-4*04 | | | | |
| 657 | IGHV4-4*05 | | | | |
| 658 | IGHV4-4*06 | | | | |
| 659 | IGHV4-4*07 | VH4-4 | | | |
| 660 | IGHV4-59*01 | VH4-59 | | | |
| 661 | IGHV4-59*02 | | | | |
| 662 | IGHV4-59*03 | | | | |
| 663 | IGHV4-59*04 | | | | |
| 664 | IGHV4-59*05 | | | | |
| 665 | IGHV4-59*06 | | | | |
| 666 | IGHV4-59*07 | | | | |
| 667 | IGHV4-59*08 | | | | |
| 668 | IGHV4-59*09 | | | | |
| 669 | IGHV4-59*10 | | | | |
| 670 | IGHV4-61*01 | | | | |
| 671 | IGHV4-61*02 | | | | |
| 672 | IGHV4-61*03 | | | | |
| 673 | IGHV4-61*04 | | | | |
| 674 | IGHV4-61*05 | | | | |
| 675 | IGHV4-61*06 | | | | |
| 676 | IGHV4-61*07 | | | | |
| 677 | IGHV4-61*08 | VH4-61 | | | |
| 678 | IGHV4-b*01 | | | | |
| 679 | IGHV4-b*02 | | | | |
| 680 | IGHV5-51*01 | | | | |
| 681 | IGHV5-51*02 | | | | |
| 682 | IGHV5-51*03 | VH5-51 | | | |
| 683 | IGHV5-51*04 | | | | |
| 684 | IGHV5-51*05 | | | | |
| 685 | IGHV5-a*01 | | | | |
| 686 | IGHV5-a*03 | | | | |
| 687 | IGHV5-a*04 | | | | |
| 688 | IGHV6-1*01 | VH6-1 | | | |
| 689 | IGHV6-1*02 | | | | |

TABLE 4

Human Light Chain Germline Kappa V Genes

| SEQ ID NO | IMGT with alleles | Zachau | SEQ ID NO | J SEGMENTS |
|---|---|---|---|---|
| 729 | IGKV1-12*01 | L5 | 795 | IGKJ1*01 |
| 730 | IGKV1-12*02 | | | |
| 731 | IGKV1-13*02 | L4/18a | | |
| 732 | IGKV1-16*01 | L1 | | |
| 733 | IGKV1-17*01 | A30 | | |
| 734 | IGKV1-17*02 | | | |

TABLE 4-continued

Human Light Chain Germline Kappa V Genes

| SEQ ID NO | IMGT with alleles | Zachau | SEQ ID NO | J SEGMENTS |
|---|---|---|---|---|
| 735 | IGKV1-27*01 | A20 | | |
| 736 | IGKV1-33*01 | O18 | | |
| 737 | IGKV1-37*01 | O14 | | |
| 738 | IGKV1-39*01 | O12 | | |
| 739 | IGKV1-39*02 | O12a | | |
| 740 | IGKV1-5*01 | L12 | | |
| 741 | IGKV1-5*02 | | | |
| 742 | IGKV1-5*03 | L12a | | |
| 743 | IGKV1-6*01 | L11 | | |
| 744 | IGKV1-8*01 | L9 | | |
| 745 | IGKV1-9*01 | L8 | | |
| 746 | IGKV1-NL1*01 | | | |
| 747 | IGKV1/OR2-0*01 | Z0 | | |
| 748 | IGKV1/OR2-108*01 | | | |
| 749 | IGKV1D-12*01 | L19 | | |
| 750 | IGKV1D-12*02 | | | |
| 751 | IGKV1D-13*01 | L18 | | |
| 752 | IGKV1D-16*01 | L15 | | |
| 753 | IGKV1D-16*02 | L15a | | |
| 754 | IGKV1D-17*01 | L14 | | |
| 755 | IGKV1D-33*01 | O8 | | |
| 756 | IGKV1D-37*01 | O4 | | |
| 757 | IGKV1D-39*01 | O2 | | |
| 758 | IGKV1D-42*01 | L22 | | |
| 759 | IGKV1D-43*01 | L23 | | |
| 760 | IGKV1D-8*01 | L24 | | |
| 761 | IGKV2-24*01 | A23 | | |
| 762 | IGKV2-28*01 | A19 | | |
| 763 | IGKV2-29*02 | A18b | | |
| 764 | IGKV2-29*03 | | | |
| 765 | IGKV2-30*01 | A17 | | |
| 766 | IGKV2-40*01 | O11 | | |
| 767 | IGKV2-40*02 | O11a | | |
| 768 | IGKV2D-24*01 | A7 | | |
| 769 | IGKV2D-26*01 | A5 | | |
| 770 | IGKV2D-26*02 | | | |
| 771 | IGKV2D-28*01 | A3 | | |
| 772 | IGKV2D-29*01 | A2 | | |
| 773 | IGKV2D-29*02 | | | |
| 774 | IGKV2D-30*01 | A1 | | |
| 775 | IGKV2D-40*01 | O1 | | |
| 776 | IGKV3-11*01 | L6 | | |
| 777 | IGKV3-11*02 | | | |
| 778 | IGKV3-15*01 | L2 | | |
| 779 | IGKV3-20*01 | A27 | | |
| 780 | IGKV3-20*02 | | | |
| 781 | IGKV3-7*01 | L10 | | |
| 782 | IGKV3-7*02 | L10a | | |
| 783 | IGKV3-7*03 | | | |
| 784 | IGKV3-NL1*01 | | | |
| 785 | IGKV3-NL2*01 | | | |
| 786 | IGKV3-NL3*01 | | | |
| 787 | IGKV3-NL4*01 | | | |
| 788 | IGKV3-NL5*01 | | | |
| 789 | IGKV3/OR2-268*01 | | | |
| 790 | IGKV3/OR2-268*02 | | | |
| 791 | IGKV3D-11*01 | L20 | | |
| 792 | IGKV3D-15*01 | L16 | | |
| 793 | IGKV3D-20*01 | A11 | | |
| 794 | IGKV3D-7*01 | L25 | | |

TABLE 5

Human Light Chain Germline Lambda V Genes

| SEQ ID NO | V Segments | Kawasaki | SEQ ID NO | J SEGMENTS |
|---|---|---|---|---|
| 796 | IGLV2-11*01 | V1-3 | 828 | IGLJ1*01 |
| 797 | IGLV2-11*02 | | 829 | IGLJ4*01 |
| 798 | IGLV2-11*03 | | | |
| 799 | IGLV2-14*01 | V1-4 | | |
| 800 | IGLV2-14*02 | | | |
| 801 | IGLV2-14*03 | | | |
| 802 | IGLV2-14*04 | | | |
| 803 | IGLV2-18*01 | V1-5 | | |
| 804 | IGLV2-18*02 | | | |
| 805 | IGLV2-18*03 | | | |
| 806 | IGLV2-18*04 | | | |
| 807 | IGLV2-23*01 | | | |
| 808 | IGLV2-23*02 | | | |
| 809 | IGLV2-23*03 | V1-7 | | |
| 810 | IGLV2-33*01 | V1-9 | | |
| 811 | IGLV2-33*02 | | | |
| 812 | IGLV2-33*03 | | | |
| 813 | IGLV2-8*01 | V1-2 | | |
| 814 | IGLV2-8*02 | | | |
| 815 | IGLV2-8*03 | | | |
| 816 | IGLV5-37*01 | V4-1 | | |
| 817 | IGLV5-39*01 | | | |
| 818 | IGLV5-39*02 | | | |
| 819 | IGLV5-45*01 | | | |
| 820 | IGLV5-45*02 | | | |
| 821 | IGLV5-45*03 | V4-2 | | |
| 822 | IGLV5-48*01 | V4-3 | | |
| 823 | IGLV5-52*01 | V4-4 | | |
| 824 | IGLV8-61*01 | V3-4 | | |
| 825 | IGLV8-61*02 | | | |
| 826 | IGLV8-61*03 | | | |
| 827 | IGLV11-55*01 | V4-6 | | |

In particular, provided herein are antibodies or antigen-binding antibody fragments that specifically bind and/or modulate an activity of DLL4. For example, antibodies that specifically bind and/or modulate an activity of DLL4 include any that contain a VH chain encoded by a sequence of nucleotides containing germline components compiled from a $V_H$ germline segment that is an IGHV1 (e.g. any set forth in any of SEQ ID NOS:574-607), an IGHV4 (e.g. any set forth in SEQ ID NOS: 608-679), an IGHV5 (e.g. any set forth in SEQ ID NOS: 680-687) or an IGHV6 (e.g., any set forth in any of SEQ ID NOS: 688 or 689); a $D_H$ germline segment that is an IGHD6 (e.g. any set forth in SEQ ID NOS: 714-717), an IGHD5 (e.g. any set forth in any of SEQ ID NOS: 710-713), an IGHD4 (e.g. any set forth in any of SEQ ID NOS: 706-709), an IGHD2 (e.g. any set forth in SEQ ID NOS: 690-697), an IGHD3 (e.g. any set forth in any of SEQ ID NOS: 698-705), or an IGHD7 (e.g. set forth in SEQ ID NO:718); and a $J_H$ germline segment that is an IGHJ1 (e.g., set forth in SEQ ID NO:719), an IGHJ2 (set forth in SEQ ID NO:720), an IGHJ4 (e.g. any set forth in any of SEQ ID NOS: 722-274), or an IGHJ6 (e.g. any set forth in SEQ ID NOS: 725-728). Such antibodies also include any that contain a VL chain encoded by a sequence of nucleotides containing germline components compiled from a Vκ germline segment that is an IGKV1 (e.g. any set forth in any of SEQ ID NOS: 729-760), an IGKV2 (e.g. any set forth in SEQ ID NOS: 761-775), or an IGKV3 (e.g. any set forth in any of SEQ ID NOS:776-794) and a Jκ germline segment that is an IGKJ1 (e.g. set forth in SEQ ID NO: 795); or from a $V_\lambda$ germline segment that is an IGLV2 (e.g. any set forth in any of SEQ ID NOS:796-815), IGLV8 (e.g. any set forth in any of SEQ ID NOS: 824-826), IGLV11 (e.g. any set forth in any of SEQ ID NO: 827), or a IGLV5 (e.g. any set forth in any of SEQ ID NOS: 816-823) and a $J_\lambda$ germline segment that is a IGLJ1 (e.g. set forth in SEQ ID NO:828) or an IGLJ4 (e.g. set forth in SEQ ID NO:829). Such antibodies also include any that are encoded by a sequence of nucleotides containing germline segments that are variants of any of the above germline segments, for example due to conservative mutations or other nucleotide mutations, so long as the resulting antibody is a functional and productive antibody and binds to DLL4 and/or modulates a functional activity.

Exemplary of antibodies against DLL4 include an antibody where the VH chain is encoded by a sequence of nucleotides compiled from a $V_H$ germline segment that is an IGHV1-3 (e.g. IGHV1-3*01 or IGHV1-3*02), an IGHV1-8*01, an IGHV1-46 (e.g. an IGHV1-46*01, IGHV1-46*02 or IGHV1-46*03), an IGHV4-31 (e.g. IGHV4-31*01, IGHV4-31*02, IGHV4-31*03, IGHV4-31*04, IGHV4-31*05, IGHV4-31*06, IGHV4-31*07, IGHV4-31*08, IGHV4-31*09 or IGHV4-31*10), an IGHV4-34 (e.g. IGHV4-34*01, IGHV4-34*02, IGHV4-34*03, IGHV4-34*04, IGHV4-34*05, IGHV4-34*06, IGHV4-34*07, IGHV4-34*08, IGHV4-34*09, IGHV4-34*10, IGHV4-34*11, IGHV4-34*12 or IGHV4-34*13), an IGHV5-51 (e.g., IGHV5-51*01, IGHV5-51*02, IGHV5-51*03, IGHV5-51*04 or IGHV5-51*05) or is an IGHV6-1 (e.g. IGHV6-1*01 or IGHV6-1*02); a $D_H$ germline segment that is an IGHD2-2 (e.g. IGHD2-2*01 or IGHD2-2*02), an IGHD2-15*01, an IGHD4-23*01, an IGHD6-6*01, an IGHD6-13*01, an IGHD5-18*01, an IGHD3-3 (e.g. IGHD3-3*01 or IGHD3-3*02), an IGHD3-10 (e.g. IGHD3-10*01 or IGHD3-10*02), or is an IGHD7-27*01; and a $J_H$ germline segment that is a IGHJ1*01, IGHJ2*01, an IGHJ4 (e.g. IGHJ4*01, IGHJ4*02 or IGHJ4*03), or is an IGHJ6 (e.g. IGHJ6*01, IGHJ6*02, IGHJ6*03, IGHJ6*04). The VL chain is encoded by a sequence of nucleotides compiled from a Vκ germline segment that is an IGKV1-5 (e.g. IGKV1-5*01, IGKV1-5*02 or IGKV1-5*03), an IGKV1-12 (e.g. IGKV1-12*01 or IGKV1-12*02), an IGKV2-D-40*01, an IGKV3-11 (e.g. IGKV3-11*01 or IGKV3-11*02), an IGKV3-15*01, or is an IGKV3-20 (e.g. IGKV3-20*01, IGKV3-20*02) and a Jκ germline segment that is an IGKJ1*01; or is compiled from a $V_\lambda$ germline segment that is an IGLV2-14 (e.g. IGLV2-14*01, IGLV2-14*02, IGLV2-14*03 or IGLV2-14*04), an IGLV8-61 (e.g. IGLV8-61*01, IGLV8-61*02 or IGLV8-61*03), an IGLV5-48*01, or an IGLV11-55*01 and a $J_\lambda$ germline segment that is an IGLJ1*01 or an IGLJ4*01.

a. Exemplary Germline-derived Anti-DLL4 Antibodies

Exemplary antibodies provided herein that specifically bind and/or modulate an activity of DLL4 are set forth in Table 6.

TABLE 6

Anti-DLL4 Antibodies

| Heavy Chain Germline Segments | SEQ ID NO nucleotide | SEQ ID NO Amino acid | Light Chain Germline Segments | SEQ ID NO nucleotide | SEQ ID NO Amino acid |
|---|---|---|---|---|---|
| IGHV1-46*01; IGHD6-6*01; IGHJ1*01 | 88 | 131 | IGKV3-11*01; IGKJ1*01 | 98 | 141 |
| IGHV5-51*03; IGHD5-18*01; IGHJ4*01 | 89 | 132 | IGLV8-61*01; IGLJ1*01 | 99 | 142 |
| IGHV6-1*01; IGHD3-3*01; IGHJ4*01 | 90 | 133 | IGLV5-48*01; IGLJ4*01 | 100 | 143 |
| IGHV1-46*01; IGHD6-13*01; IGHJ4*01 | 92 | 135 | IGKV3-15*01; IGKJ1*01 | 102 | 145 |
| IGHV4-34*01; IGHD7-27*01; IGHJ4*01 | 94 | 137 | IGKV1-12*01; IGKJ1*01 | 103 | 146 |
| IGHV1-46*01; IGHD6-13*01; IGHJ4*01 | 92 | 135 | IGKV3-20*01; IGKJ1*01 | 101 | 144 |
| IGHV1-3*02; IGHD4-23*01; IGHJ4*01 | 95 | 138 | IGKV1-5*01; IGKJ1*01 | 104 | 147 |
| IGHV1-46*01; IGHD2-15*01; IGHJ2*01 | 93 | 136 | IGKV1-5*01; IGKJ1*01 | 104 | 147 |
| IGHV1-46*01; IGHD3-10*01; IGHJ4*01 | 91 | 134 | IGKV1-5*01; IGKJ1*01 | 104 | 147 |
| IGHV1-8*01; IGHD2-2*01; IGHJ6*01 | 96 | 139 | IGKV1-5*01; IGKJ1*01 | 104 | 147 |
| IGHV1-46*01; IGHD6-13*01; IGHJ4*01 | 92 | 135 | IGKV2D-40*01; IGKJ1*01 | 105 | 148 |
| IGHV4-34*01; IGHD7-27*01; IGHJ4*01 | 94 | 137 | IGLV2-14*01; IGLJ4*01 | 106 | 149 |
| IGHV4-31*02; IGHD2-15*01; IGHJ2*01 | 97 | 140 | IGLV2-14*01; IGLJ4*01 | 106 | 149 |
| IGHV4-34*01; IGHD7-27*01; IGHJ4*01 | 94 | 137 | IGLV11-55*01; IGLJ4*01 | 107 | 150 | b. Germline-Derived Modified Antibodies

Anti-DLL4 antibodies provided herein include antibodies that are optimized compared to an anti-DLL4 germline-derived antibody or antigen-binding antibody fragment. Germline-derived modified antibodies include one or more mutations in the VH chain and/or one or more mutations in the VL chain compared to a germline-derived antibody. For example, the antibodies can contain 1, 2, 3, 4, 5, 6, 7, 8, 9, 10, 11, 12, 13, 14, 15, 16, 17, 18, 19, 20 or more amino acid replacements in the VH chain and/or VL chain compared to the corresponding germline-derived antibody. The mutations can be in the VH chain, for example, in any one or more of the amino acid residues of a $V_H$, $D_H$ or $J_H$ region. Alternatively, or in addition, the mutations can be in the VL chain, for example, in any one or more of the amino acid residues of the $V_L$ or $J_L$ region.

Optimized antibodies containing one or more mutations exhibit improved activity compared to the parent antibody (e.g. germline-derived antibody not containing the modification(s)). The antibodies exhibit an improved functional activity, either agonistic or antagonistic, against the DLL4 target protein. In other examples, the antibodies exhibit an improved binding affinity for DLL4. Generally, an activity or binding affinity is increased by at or about 1.5-fold, 2-fold, 3-fold, 4-fold, 5-fold, 6-fold, 7-fold, 8-fold, 9-fold, 10-fold, 20-fold, 30-fold, 40-fold, 50-fold, 60-fold, 70-fold, 80-fold, 90-fold, 100-fold, 200-fold, 300-fold, 400-fold, 500-fold, 600-fold, 700-fold, 800-fold, 900-fold, 1000-fold or more compared to an activity or binding affinity of the parent antibody (e.g. germline-derived antibody not containing the modification(s)). For example, as described in the Examples, optimized anti-DLL4 antibodies provided herein exhibit a binding affinity that is improved by at least 100-fold to 1000-fold compared to the parent antibody. Such antibodies exhibit a nanomolar binding affinity. Typically, germline-derived modified anti-DLL4 antibodies provided herein exhibit a binding affinity that is at least $10^{-9}$ M, for example, that is or is about $1 \times 10^{-9}$ M, $2 \times 10^{-9}$ M, $3 \times 10^{-9}$ M, $4 \times 10^{-9}$ M, $5 \times 10^{-9}$ M, $6 \times 10^{-9}$ M, $7 \times 10^{-9}$ M, $8 \times 10^{-9}$ M, $9 \times 10^{-9}$ M, $1 \times 10^{-10}$ M, $2 \times 10^{-10}$ M, $3 \times 10^{-10}$ M, $4 \times 10^{-10}$ M, $5 \times 10^{-10}$ M, $10^{-11}$ M, $10^{-12}$ M or lower.

i. Variable Heavy Chain

For example, provided herein are germline-derived modified anti-DLL4 antibodies that contain one or more mutations in the VH chain of an anti-DLL4 Hit, for example, any set forth in any of SEQ ID NOS: 131-140.

In one example, a germline-derived modified anti-DLL4 antibody includes one or more mutations in a VH chain set forth in SEQ ID NO:132. The mutation(s) include one or more mutations at positions G24, Y27, S28, F29, T30, S31, Y32, W33, I34, G35, I50, I51, Y52, P52a, G53, D54, S55, D56, T57, S82a, R95, G96, Y97, S98, Y99, G100, Y100a, D100b, Y100c, F100d, D101 and/or Y102 set forth in the VH chain set forth in SEQ ID NO: 132, based on kabat numbering. The mutation can be to any other amino acid residue, in particular, the mutation is an alanine (A), phenylalanine (F), proline (P), tyrosine (Y), glutamine (Q), valine (V), isoleucine (I), glycine (G), leucine (L), tryptophan (W), lysine (K), asparagine (N), histidine (H), cysteine (C), glutamic acid (E), serine (S), Arginine (R) or threonine (T). Exemplary of such mutations are amino acid replacements G24A, G24L, G24S, G24R, G24T, S28A, S28R, S28K, S28N, F29A, T30A, W33A, I34A, G35T, G35A, G35V, I50A, I51A, Y52A, P52aA, D54A, S55G, D56A, T57D, T57A, S82aV, S82aL, R95A, G96K, G96R, G96L, G96D, G96T, Y97A, Y97H, S98A, Y99A, G100A, G100D, G100L, G100P, G100R, G100M, G100K, G100S, G100R, G100T, Y100aA, D100bA, and/or D101A in the VH chain set forth in SEQ ID NO:132. In particular, exemplary of such mutations are amino acid replacements G24A, G24T, G24L, S28A, S28R, S28K, G35A, G25V, T57A, T57D, G96A, G96K, G96L, G96R, G100A, G100T and/or G100D. For example, exemplary of such mutations are amino acid replacements G24A, G24T, G24L, S28R, G35V, G96K, and/or G100T.

In another example, a germline-derived modified anti-DLL4 antibody provided herein includes one or more mutations in a VH chain set forth in SEQ ID NO:131. The mutation(s) include one or more mutations at positions T28, F29, T30, S31, Y33, I50, I51, N52, P52a, S53, G54, G55, S56, T57, S58, S82a, E96, Y97, S98, S99, S100, S100a, A100b, E100c, F100e, Q101 and/or H102 in the VH chain set forth in SEQ ID NO: 131, based on kabat numbering. The mutation can be to any other amino acid residue, in particular, the mutation is alanine (A), phenylalanine (F), proline (P), tyrosine (Y), glutamine (Q), valine (V), isoleucine (I), glycine (G), leucine (L), tryptophan (W), lysine (K), asparagine (N), aspartic acid (D), histidine (H), cysteine (C), glutamic acid (E), serine (S), Arginine (R) or threonine (T). Exemplary of such mutations are amino acid replacements T28A, F29A, T30A, S31A, Y33A, I50A, I50T, I51A, I51T, I51V, I51N, I51R, I51W, I51S, I51G, I51V, I51E, I51H, I51Y, N52A, N52V, N52G, N52T, N52P, N52L, N52W, N52Y, N52V, N52S, N52Q, N52K, P52aA, P52aM, P52aE, P52aH, P52aY, P52aT, P52aN, P52aR, P52aW, P52aS, P52aG, S53A, S53I, S53E, S53R, S53G, S53T, S53L, S53V, S53N, S53P, G54A, G54W, G54D, G55A, G55V, G55E, G55S, G55K, G55T, G55L, G55R, G55H, G55I, G55W, S58A, T57A, S58A, S82aG, S82aQ, S82aN, S82aH, S82aR, S82aK, S82aT, E96A, Y97A, S98A, S98Q, S98V, S98I, S98G, S99P, S99A, S99L, S99W, S99F, S99N, S99H, S99C, S99G, S100F, S100A, S100G, S100C, S100H, S100L, S100R, S100aA, A100bE, E100cA, Q101A, H102A, H102S, H102F and/or H102Y in the VH chain set forth in SEQ ID NO:131. In particular, exemplary of such mutations are amino acid replacements T28A, T30A, S31A, I51A, I51T, I51V, I51E, N52A, N52V, N52L, N52W, N52G, N52T, N52S, N52Q, N52K, P52Aa, S53A, S53G, S53T, G55A, G55V, G55E, G55N, G55S, G55K, G55D, G55T, G55L, G55H, G55R, G55I, G55W, S56A, S82aT, S98A, S98Q, S98V, S98I, S99A, S99L, S99W, S99C, S99P, S100A, S100H, S100F, S100L, S100R, S100G, H102A, H102Y, H102F, and/or H102S. For example, exemplary of such mutations are amino acid replacements I51A, I51V, N52L, S53A, S53T, G55H, S98A, S99P, S100F, H102Y, and/or H102F.

ii. Variable Light Chain

Optimized anti-DLL4 antibodies provided herein also can contain one or more amino acid mutations in the VL chain. For example, provided herein are germline-derived modified anti-DLL4 antibodies that contain one or more mutations in the VH chain of an anti-DLL4 Hit, for example, any set forth in any of SEQ ID NOS: 141-150.

In one example, a germline-derived modified anti-DLL4 antibody includes one or more mutations in a VL chain set forth in SEQ ID NO: 141. The mutations(s) include one or more mutations at positions R24, Q27, S28, S30, S31, Y32, D50, A51, S52, N53, R54, A55, T56, F62, S76, R91, S92, N93 and/or W94 set forth in the VL chain set forth in SEQ ID NO:141, based on kabat numbering. The mutation can be to any other amino acid residue, in particular, the mutation is an alanine (A), phenylalanine (F), proline (P), tyrosine (Y), glutamine (Q), valine (V), isoleucine (I), glycine (G), leucine (L), tryptophan (W), lysine (K), asparagine (N), histidine (H), cysteine (C), glutamic acid (E), serine (S), aspartic acid (D), methionine (M), Arginine (R) or threonine (T). Exemplary of such mutations are amino acid replacements R24G, Q27L, S28P, S28G, S28K, S28V, S28F, S28P, S28T, S28L, S28Q, S28A, S28N, S28H, S28I, S28R, S28W, S28M, S28E, S30N, S30W, S30R, S30L, S30C, S30D, S30L, S30T, S30P, S30Y, S30Q, S30A, S30G, S30V, S31K, S31T, S31N, S31K, S31L, S31M, S31F, S31I, S31V, S31H, S31A, S31P, S31D, S31R, S31Y, S31Q, S31E, S31G, Y32V, Y32S, D50A, A51T, S52A, S52L, S52T, S52R, S52S, S52W, S52N, S52P, S52M, N53A, N53E, N53G, N53M, N53C, N53H, N53P, R54A, A55T, A55R, A55C, A55S, A55G, T56A, F62L, S76E, S76Q, S76P, S76L, S76T, S76G, S76A, S76Y, S76N, R91P, R91L, R91G, S92P, S92A, S92Q, S92V, S92T, S92R, S92G, S92V, S92M, S92N, S92C, N93Y, N93S, N93H, N93Q, W94R, W94S, W94T, W94L, W94P and/or W94M. In particular, exemplary of such mutations are amino acid replacements S28N, S28G, S28H, S28T, S30A, S30D, S30Q, S30G, S30W, S30R, S31A, S31T, S31N, S31H, S31K, S31Y, S31R, S52A, S52L, S52T, S52R, S52M, N53A, N53H, N53G, A55T, A55S, A55G, S76T and/or S76Y. For example, exemplary of such mutations are amino acid replacements S28N, S30D, S31H, S31K, S52L, A55S and/or A55G.

In one example, a germline-derived modified anti-DLL4 antibody includes one or more mutations in a VL chain set forth in SEQ ID NO: 142. The mutations(s) include one or more mutations at positions G24, L25, S26, S27, G27a, S27b, V27c, S28, T29, S30, Y31, Y32, P33, S34, S50, T51, N52, T53, R54, S55, S56, T76, V89, L90, Y91, M92, G93, S94, G95, I95a and/or S95b, set forth in the kabat numbering in the VL chain set forth in SEQ ID NO:142, based on kabat numbering. The mutation can be to any other amino acid residue, in particular, the mutation is an alanine (A), phenylalanine (F), proline (P), tyrosine (Y), glutamine (Q), valine (V), isoleucine (I), glycine (G), leucine (L), tryptophan (W), lysine (K), asparagine (N), histidine (H), cysteine (C), glutamic acid (E), serine (S), aspartic acid (D), methionine (M), Arginine (R) or threonine (T). Exemplary of such mutations are amino acid replacements G24A, G24R, G24L, L25A, S26A, S27A, G27aA, S27bA, V27cA, S28A, T29A, S30A, Y31A, Y32A, P33A, S34A, S50A, S50F, S50G, S50C, S50R, S50L, S50M, S50V, S50P, S50T, S50H, S50Q, S50N, S50K, S50D, S50E, S50W, T51A, T51F, T51L, T51I, T51M, T51V, T51S, T51P, T51Y, T51H, T51Q, T51N, T51K, T51D, T51E, T51W, T51R, T51G, N52A, T53A, R54A, R54I, R54Y, R54D, R54G, S55A, S55F, S55L, S55I, S55M, S55V, S55P, S55T, S55Y, S55H, S55Q, S55N, S55K, S55D, S55E, S55W, S55R, S55G, S56A, T76S, T76E, T76Y, T76M, T76L, T76K, T76V, V89A, V89P, V89T, V89S, V89L, V89R, V89C, V89E, V89W, V89N, V89I, V89G, V89H, L90A, Y91A, M92A, M92E, M92S, M92G, M92L, M92P, M92V, M92D, M92R, M92N, M92T, M92F, G93A, S94A, S94W, S94G, S94P, S94R, S94L, S94M, S94E, S94V, G94A, I95aA and/or S95bA. In particular, exemplary of amino acid replacements are G24A, S26A, S27A, G27aA, S27bA, S28A, T29A, S30A, S50A, S50G, S50M, S50H, S50N, S50V, S50K, S50L, T51A, N52A, T53A, R54A, R54G, R54Y, R54S, S55A, S56A, T76E, T76M, T76Y, V89A, V89L, M92A, M92R, S94A, S94M, S94G and/pr S94P. For example, exemplary of such mutations are S50G, S50M, R54A, R54Y, V89L, M92R, S94M and/or S94P.

iii. Exemplary Germline-Derived Modified Antibodies

Provided herein are anti-DLL4 antibodies containing a variable heavy chain variant, for example, any set forth in SEQ ID NO:151-263, 381-438, and 894-898. In particular, among the exemplary anti-DLL4 antibodies provided herein, anti-DLL4 antibodies contain a variable heavy chain sequence having a sequence of amino acids set forth in SEQ ID NOS:155-157, 195, 219, 233, 238-239, 244, 263, 384, 414, 420 and 433-434.

Exemplary variable light chain variants include any set forth in SEQ ID NOS: 264-380, 439-571. In particular, among the exemplary anti-DLL4 antibodies provided herein, anti-DLL4 antibodies contain a variable heavy chain sequence having a sequence of amino acids set forth in SEQ ID NOS:343, 351, 367-370, 479, and 536-537.

In the anti-DLL4 antibodies provided herein, any of the exemplary variable heavy chains can be paired with any of the exemplary variable light chains. Exemplary anti-DLL4 antibodies include any of the heavy and light chain paired antibodies set forth in Example 5 herein (e.g. Tables 30 and 31).

2. Anti-DLL4: Complementary Determining Regions (CDRs)

Provided herein are anti-DLL4 antibodies that have a variable heavy (VH) chain and/or a variable light (VL) chain that contains CDR residues involved in binding to DLL4. The DLL4 antibodies provided herein can contain 1, 2, 3, 4, 5, or 6 of the provided CDRs (CDRH1, CDRH2, CDRH3, CDRL1, CDRL2 and/or CDRL3), or modified forms thereof. The anti-DLL4 antibodies provided herein further can contain additional modification in other regions of the antibody as described elsewhere herein. For example, anti-DLL4 antibodies can contain one or more modifications in the framework region.

For example, provided herein are anti-DLL4 antibodies that have a VH chain that contains:

a CDRH1 (corresponding to amino acid positions 26-35 based on kabat numbering) that has a sequence of amino acids of GYTFTSYYMH (SEQ ID NO: 830), GYSFTSYWIG (SEQ ID NO:831), GDSVSSNSAA (SEQ ID NO:832), GGSFSGYYWS (SEQ ID NO:833), GYTFTSYAMH (SEQ ID NO:834), GYTFTSYAIN (SEQ ID NO:835), or GGSISSGGYY (SEQ ID NO:836), or a sequence of amino acids that is a subset of any of SEQ ID NOS: 830-836, or has a sequence of amino acids of modified form of any of SEQ ID NOS:830-836; and/or a CDRH2 (corresponding to amino acid positions 50-65 based on kabat numbering) that has a sequence of amino acids of IINPSGGSTSYAQKFQG (SEQ ID NO:844), IIYPGDSDTRYSPSFQG (SEQ ID NO:845), RTYYRSKWYNDYAVSVKS (SEQ ID NO:846), EINHSGSTNYNPSLKS (SEQ ID NO:847), INSNAGNGNTKYSQEFQG (SEQ ID NO: 848), WMNPNSGNTGYAQKFQG (SEQ ID NO:849); or YIYYSGSTYYNPSLKS (SEQ ID NO:850) or has a sequence of amino acids of modified form of any of SEQ ID NOS: 844-850; and/or a CDRH3 (corresponding to amino acid positions 95-102) that has a sequence of amino acids of EEYSSSSAEYFQH (SEQ ID NO:851), RGYSYGYDYFDY (SEQ ID NO:852), EYYDFWSGYYTDYFDY (SEQ ID NO:853), EGYSSSWYDYFDY (SEQ ID NO:854), ANWGDYFDY (SEQ ID NO:855), DDYGGNSDYFDY (SEQ ID NO:856), EGYCSGGSCYS (SEQ ID NO:857), EYYYGSGSYYNDYFDY (SEQ ID NO:858), GCYCSSTSCYADYYYYYGMDV (SEQ ID NO:859), or GSCYSYWYFDL (SEQ ID NO:860), or has a sequence of amino acids of modified form any of SEQ ID NOS: 851-860.

Also provided herein are anti-DLL4 antibodies that have a variable light (VL) chain that contains:

a CDRL1 (corresponding to amino acid positions 24 to 33 or 34 based on kabat numbering) that has a sequence of amino acids of RASQSVSSYLA (SEQ ID NO: 861), GLSSGSVSTSYYPS (SEQ ID NO:862), TLRSGINLGSYRIF (SEQ ID NO:863), RASQSVSSNLA (SEQ ID NO:864); RASQGISSWLA (SEQ ID NO:865); RASQVSSSYLA (SEQ ID NO:866), RASQSISSWLA (SEQ ID NO:867), RSSQSLLDSDDGNTYLD (SEQ ID NO:868), TGTSSDVGGTNYVS (SEQ ID NO:869), or TLSSDLSVGGKNMF (SEQ ID NO:870), or has a sequence of amino acids of modified form of any of SEQ ID NOS: 861-870;

a CDRL2 (corresponding to amino acid positions 50-56 based on kabat numbering) that has a sequence of amino acids of amino acids of DASNRAT (SEQ ID NO:871), STNTRSS (SEQ ID NO: 872), YYSDSSK (SEQ ID NO:873), GASTRAT (SEQ ID NO:874), AASSLQS (SEQ ID NO:875), GASSRAT (SEQ ID NO:876), DASSLGS (SEQ ID NO:877), TLSYRAS (SEQ ID NO:878), EVSNRPS (SEQ ID NO:879), or HYSDSDK (SEQ ID NO:880), or has a sequence of amino acids of modified form of any of SEQ ID NOS: 871-880); and/or a CDRL3 (corresponding to amino acid positions 89-97 based on kabat numbering) that has a sequence of amino acids of QQRSNWPPWT (SEQ ID NO:881), VLYMGSGISYV (SEQ ID NO:882), MIWHSSASFV (SEQ ID NO: 883), QQYNNWPPWT (SEQ ID NO: 884) QANSFPPWT (SEQ ID NO:885), QQYGSSPPWT (SEQ ID NO: 886), QQYNSYSPWT (SEQ ID NO:887), MQRIEFPSWT (SEQ ID NO: 888), SSYTSSSTLFV (SEQ ID NO: 889), or QVYESSANFV (SEQ ID NO: 890), or has a sequence of amino acids of modified form any of SEQ ID NOS: 881-890.

Exemplary of anti-DLL4 antibodies are any that contain a variable heavy chain or a variable light chain set forth in Tables 7-8. The CDRs, including the SEQ ID NOS thereof, are indicated in the Tables.

TABLE 7

DLL4 Antibody Heavy Chains

| Heavy Chain | CDR1 | CDR2 | CDR3 |
|---|---|---|---|
| VH1-46_IGHD6-6*01_IGHJ1*01 | GYTFTSYYMH (SEQ ID NO: 830) SYYMH (SEQ ID NO: 837) | IINPSGGSTSYAQKFQG (SEQ ID NO: 844) | EEYSSSSAEYFQH (SEQ ID NO: 851) |
| VH5-51_IGHD5-18*01_IGHJ4*01 | GYSFTSYWIG (SEQ ID NO: 831) SYWIG (SEQ ID NO: 838) | IIYPGDSDTRYSPSFQG (SEQ ID NO: 845) | RGYSYGYDYFDY (SEQ ID NO: 852) |
| VH6-1_IGHD3-3*01_IGHJ4*01 | GDSVSSNSAA (SEQ ID NO: 832) SNSAA (SEQ ID NO: 839) | RTYYRSKWYNDYAVSVKS (SEQ ID NO: 846) | EYYDFWSGYYTDYFDY (SEQ ID NO: 853) |
| VH1-46_IGHD6-13*01_IGHJ4*01 | GYTFTSYYMH (SEQ ID NO: 830) SYYMH (SEQ ID NO: 837) | IINPSGGSTSYAQKFQG (SEQ ID NO: 844) | EGYSSSWYDYFDY (SEQ ID NO: 854) |
| VH4-34_IGHD7-27*01_IGHJ4*01 | GGSFSGYYWS (SEQ ID NO: 833) GYYWS (SEQ ID NO: 840) | EINHSGSTNYNPSLKS (SEQ ID NO: 847) | ANWGDYFDY (SEQ ID NO: 855) |
| VH1-3_IGHD4-23*01_IGHJ4*01 | GYTFTSYAMH (SEQ ID NO: 834) SYAMH (SEQ ID NO: 841) | INSNAGNGNTKYSQEFQG (SEQ ID NO: 848) | DDYGGNSDYFDY (SEQ ID NO: 856) |
| VH1-46_IGHD2-15*01_IGHJ2*01 | GYTFTSYYMH (SEQ ID NO: 830) SYYMH (SEQ ID NO: 837) | IINPSGGSTSYAQKFQG (SEQ ID NO: 844) | EGYCSGGSCYS (SEQ ID NO: 857) |
| VH1-46_IGHD3-10*01_IGHJ4*01 | GYTFTSYYMH (SEQ ID NO: 830) SYYMH (SEQ ID NO: 837) | IINPSGGSTSYAQKFQG (SEQ ID NO: 844) | EYYYGSGSYYNDYFDY (SEQ ID NO: 858) |
| VH1-8_IGHD2-2*01_IGHJ6*01 | GYTFTSYAIN (SEQ ID NO: 835) SYAIN (SEQ ID NO: 842) | WMNPNSGNTGYAQKFQG (SEQ ID NO: 849) | GCYCSSTSCYADYYYYYGMDV (SEQ ID NO: 859) |
| VH4-31_IGHD2-15*01_IGHJ2*01 | GGSISSGGYY (SEQ ID NO: 836) SGGYY (SEQ ID NO: 843) | YIYYSGSTYYNPSLKS (SEQ ID NO: 850) | GSCYSYWYFDL (SEQ ID NO: 860) |

TABLE 8

DLL4 Antibody Light Chains

| Light Chain | CDR1 | CDR2 | CDR3 |
|---|---|---|---|
| L6_IGKJ1*01 | RASQSVSSYLA (SEQ ID NO: 861) | DASNRAT (SEQ ID NO: 871) | QQRSNWPPWT (SEQ ID NO: 881) |
| V3-4_IGLJ1*01 | GLSSGSVSTSYYPS (SEQ ID NO: 862) | STNTRSS (SEQ ID NO: 872) | VLYMGSGISYV (SEQ ID NO: 882) |
| V4-3_IGLJ4*01 | TLRSGINLGSYRIF (SEQ ID NO: 863) | YYSDSSK (SEQ ID NO: 873) | MIWHSSASFV (SEQ ID NO: 883) |
| L2_IGKJ1*01 | RASQSVSSNLA (SEQ ID NO: 864) | GASTRAT (SEQ ID NO: 874) | QQYNNWPPWT (SEQ ID NO: 884) |

TABLE 8-continued

DLL4 Antibody Light Chains

| Light Chain | CDR1 | CDR2 | CDR3 |
|---|---|---|---|
| L5_IGKJ1*01 | RASQGISSWLA (SEQ ID NO: 865) | AASSLQS (SEQ ID NO: 875) | QANSFPPWT (SEQ ID NO: 885) |
| A27_IGKJ1*01 | RASQVSSSYLA (SEQ ID NO: 866) | GASSRAT (SEQ ID NO: 876) | QQYGSSPPWT (SEQ ID NO: 886) |
| L12_IGKJ1*01 | RASQSISSWLA (SEQ ID NO: 867) | DASSLGS (SEQ ID NO: 877) | QQYNSYSPWT (SEQ ID NO: 887) |
| O1_IGKJ1*01 | RSSQSLLDSDDGNTYLD (SEQ ID NO: 868) | TLSYRAS (SEQ ID NO: 878) | MQRIEFPSWT (SEQ ID NO: 888) |
| V1-4_IGLJ4*01 | TGTSSDVGGTNYV (SEQ ID NO: 869) | EVSNRPS (SEQ ID NO: 879) | SSYTSSSTLFV (SEQ ID NO: 889) |
| V4-6_IGLJ4*01 | TLSSDLSVGGKNMF (SEQ ID NO: 870) | HYSDSDK (SEQ ID NO: 880) | QVYESSANFV (SEQ ID NO: 890) |

Also provided herein are anti-DLL4 antibodies that contain one or more, such as 1, 2, 3, 4, 5 or 6, CDRs that is(are) modified compared to a CDRH1 set forth in any of SEQ ID NOS: 830-836, a CDRH2 set forth in any of SEQ ID NOS: 844-850, a CDRH3 set forth in any of SEQ ID NOS: 851-860, a CDRL1 set forth in any of SEQ ID NOS: 861-870, a CDRL2 set forth in any of SEQ ID NOS: 871-880 and/or a CDRL3 set forth in any of SEQ ID NOS: 881-890. Such modified forms include those that exhibit at least 65%, 70%, 75%, 80%, 85%, 90%, 95%, 96%, 97%, 98%, 99% sequence identity to a CDR set forth in any of SEQ ID NOS: 830-836, 844-890.

For example, provided herein are anti-DLL4 antibodies that contain a modified CDRH1 that is modified compared to the CDRH1 set forth in SEQ ID NO: 830 or SEQ ID NO:831. Amino acid replacements can be to any other amino acid residue, in particular, the mutation is alanine (A), phenylalanine (F), proline (P), tyrosine (Y), glutamine (Q), valine (V), isoleucine (I), glycine (G), leucine (L), tryptophan (W), lysine (K), asparagine (N), aspartic acid (D), histidine (H), cysteine (C), glutamic acid (E), serine (S), Arginine (R) or threonine (T). In one example, a CDRH1 set forth in SEQ ID NO:830 is modified to contain one or more mutations at positions T28, F29, T30, S31 and/or Y33, based on kabat numbering. For example, exemplary of such amino acid replacements include T28A, F29A, T30A, S31A, Y33A. In another example, a CDRH1 set forth in SEQ ID NO:831 is modified to contain one or more mutations at positions S28, F29, T30, W33, I34 or G35, based on kabat numbering. For example, exemplary of such amino acid replacements include S28A, S28R, S28K, S28N, F29A, T30A, W33A, I34A, G35T, G35A and/or G35V. The CDRH1 can contain 1, 2, 3, 4, 5, 6 or more amino acid modifications. An exemplary combination mutant is S28R/G35V.

In another example, provided herein are anti-DLL4 antibodies that contain a modified CDRH2 that is modified compared to the CDRH2 set forth in SEQ ID NO: 844 or SEQ ID NO:845. Amino acid replacements can be to any other amino acid residue, in particular, the mutation is alanine (A), phenylalanine (F), proline (P), tyrosine (Y), glutamine (Q), valine (V), isoleucine (I), glycine (G), leucine (L), tryptophan (W), lysine (K), asparagine (N), aspartic acid (D), histidine (H), cysteine (C), glutamic acid (E), serine (S), Arginine (R) or threonine (T). In one example, a CDRH2 set forth in SEQ ID NO:844 is modified to contain one or more mutations at positions I50, I51, N52, P52a, S53, G54, G55, G56, T57 and/or S58, based on kabat numbering. For example, exemplary of such amino acid replacements include I50A, I50T, I51A, I51T, I51V, I51N, I51R, I51W, I51S, I51G, I51V, I51E, I51H, I51Y, N52A, N52V, N52G, N52T, N52P, N52L, N52W, N52Y, N52V, N52S, N52Q, N52K, P52aA, P52aM, P52aE, P52aH, P52aY, P52aT, P52aN, P52aR, P52aW, P52aS, P52aG, S53A, S53I, S53E, S53R, S53G, S53T, S53L, S53V, S53N, S53P, G54A, G54W, G54D, G55A, G55V, G55E, G55S, G55K, G55T, G55L, G55R, G55H, G55I, G55W, S58A, T57A and/or S58A. In another example, CDRH2 set forth in SEQ ID NO:845 is modified to contain one or more mutations at positions I50, I51, Y52, P52a, D54, S55, D56 and/or T57, based on kabat numbering. For example, exemplary of such amino acid replacements include I51A, I51A, Y52A, P52aA, D54A, S55G, D56A, T57D and/or T57A. The CDRH2 can contain 1, 2, 3, 4, 5, 6, 7, 8, 9, 10 or more amino acid modifications. Exemplary combination modifications in CDRH2 set forth in SEQ ID NO:844 include, for example, I51V/N52L/S53T/G55H, N52L/S53T/G55H, I51E/N52L/S53T/G55H and/or I51N/N52L/S53T/G55H.

In a further example, provided herein are anti-DLL4 antibodies that contain a modified CDRH3 that is modified compared to the CDRH3 set forth in SEQ ID NO: 851 or SEQ ID NO:852. Amino acid replacements can be to any other amino acid residue, in particular, the mutation is alanine (A), phenylalanine (F), proline (P), tyrosine (Y), glutamine (Q), valine (V), isoleucine (I), glycine (G), leucine (L), tryptophan (W), lysine (K), asparagine (N), aspartic acid (D), histidine (H), cysteine (C), glutamic acid (E), serine (S), Arginine (R) or threonine (T). In one example, a CDRH3 set forth in SEQ ID NO:851 is modified to contain one or more mutations at positions E96, Y97, S98, S99, S100, S100a, A100b, E100c, Q101 and/or H102, based on kabat numbering. For example, exemplary of such amino acid replacements include E96A, Y97A, S98A, S98Q, S98V, S98I, S98G, S99P, S99A, S99L, S99W, S99F, S99N, S99H, S99C, S99G, S100F, S100A, S100G, S100C, S100H, S100L, S100R, S100aA, A100bE, E100cA, Q101A, H102A, H102S, H102F and/or H102Y. In another example, CDRH3 set forth in SEQ ID NO:852 is modified to contain one or more mutations at positions R95, G96, Y97, S98, Y99, G100, Y100a, D100b, and/or D101, based on kabat numbering. For example, exemplary of such amino acid replacements include R95A, G96K, G96R, G96L, G96D, G96T, Y97A, Y97H, S98A, Y99A, G100A, G100D, G100L, G100P, G100R, G100M, G100K, G100S, G100R, G100T, Y100aA, D100bA and/or D101A. The CDRH3 can contain 1, 2, 3, 4, 5, 6, 7, 8, 9, 10 or more amino acid modifications. Exemplary combination modifications in CDRH3 set forth in SEQ ID NO:851 include, for example, S98A/S99P/S100F, S98A/S99P/S100F/H102F and/or S98A/S99P/S100F/H102Y. Exemplary combination modification in CDRH3 set forth in SEQ ID NO:852 include, for example, G96K/G100T.

Also provided herein are anti-DLL4 antibodies that contain a modified CDRL1 that is modified compared to the CDRL1 set forth in SEQ ID NO: 861 or SEQ ID NO:862. Amino acid replacements can be to any other amino acid residue, in particular, the mutation is alanine (A), phenylalanine (F), proline (P), tyrosine (Y), glutamine (Q), valine (V), isoleucine (I), glycine (G), leucine (L), tryptophan (W), lysine (K), asparagine (N), histidine (H), cysteine (C), glutamic acid (E), serine (S), aspartic acid (D), methionine (M), Arginine (R) or threonine (T). In one example, a CDRL1 set forth in SEQ ID NO:861 is modified to contain one or more mutations at positions R24, Q27, S28, S30, S31 and/or Y32, based on kabat numbering. For example, exemplary of such amino acid replacements include R24G, Q27L, S28P, S28G, S28K, S28V, S28F, S28P, S28T, S28L, S28Q, S28A, S28N, S28H, S28I, S28R, S28W, S28M, S28E, S30N, S30W, S30R, S30L, S30C, S30D, S30L, S30T, S30P, S30Y, S30Q, S30A, S30G, S30V, S31K, S31T, S31N, S31K, S31L, S31M, S31F, S31I, S31V, S31H, S31A, S31P, S31D, S31R, S31Y, S31Q, S31E, S31G, Y32V and/or Y32S. In another example, CDRL1 set forth in SEQ ID NO:862 is modified to contain one or more mutations at positions G24, L25, S26, S27, G27a, S27b, V27c, S28, T29, S30, Y31, Y32, P33, based on kabat numbering. For example, exemplary of such amino acid replacements include G24A, G24R, G24L, L25A, S26A, S27A, G27aA, S27bA, V27cA, S28A, T29A, S30A, Y31A, Y32A and/or P33A. The CDRL1 can contain 1, 2, 3, 4, 5, 6, 7, 8, 9, 10, 11, 12, 13 or more amino acid modifications. Exemplary combination modifications in CDRL1 set forth in SEQ ID NO:861 include, for example, S28N/S30D/S31H.

In an additional example, provided herein are anti-DLL4 antibodies that contain a modified CDRL2 that is modified compared to the CDRL2 set forth in SEQ ID NO: 871 or SEQ ID NO:872. Amino acid replacements can be to any other amino acid residue, in particular, the mutation is alanine (A), phenylalanine (F), proline (P), tyrosine (Y), glutamine (Q), valine (V), isoleucine (I), glycine (G), leucine (L), tryptophan (W), lysine (K), asparagine (N), histidine (H), cysteine (C), glutamic acid (E), serine (S), aspartic acid (D), methionine (M), Arginine (R) or threonine (T). In one example, a CDRL2 set forth in SEQ ID NO:871 is modified to contain one or more mutations at positions D50, A51, S52, N53, R54, A55 and/or T56, based on kabat numbering. For example, exemplary of such amino acid replacements include D50A, A51T, S52A, S52L, S52T, S52R, S52S, S52W, S52N, S52P, S52M, N53A, N53E, N53G, N53M, N53C, N53H, N53P, R54A, A55T, A55R, A55C, A55S, A55G and/or T56A. In another example, CDRL2 set forth in SEQ ID NO:872 is modified to contain one or more mutations at positions S50, T51, N52, T53, R54, S55 and/or S56, based on kabat numbering. For example, exemplary of such amino acid replacements include S50A, S50F, S50G, S50C, S50R, S50L, S50M, S50V, S50P, S50T, S50H, S50Q, S50N, S50K, S50D, S50E, S50W, T51A, T51F, T51L, T51I, T51M, T51V, T51S, T51P, T51Y, T51H, T51Q, T51N, T51K, T51D, T51E, T51W, T51R, T51G, N52A, T53A, R54A, R54I, R54Y, R54D, R54G, S55A, S55F, S55L, S55I, S55M, S55V, S55P, S55T, S55Y, S55H, S55Q, S55N, S55K, S55D, S55E, S55W, S55R, S55G and/or S56A. The CDRL2 can contain 1, 2, 3, 4, 5, 6, 7 or more amino acid modifications. Exemplary combination modifications in CDRL2 set forth in SEQ ID NO:871 include, for example, S52L/A55S and/or S52L/A55G.

In a further example, provided herein are anti-DLL4 antibodies that contain a modified CDRL3 that is modified compared to the CDRL3 set forth in SEQ ID NO: 881 or SEQ ID NO:882. Amino acid replacements can be to any other amino acid residue, in particular, the mutation is alanine (A), phenylalanine (F), proline (P), tyrosine (Y), glutamine (Q), valine (V), isoleucine (I), glycine (G), leucine (L), tryptophan (W), lysine (K), asparagine (N), histidine (H), cysteine (C), glutamic acid (E), serine (S), aspartic acid (D), methionine (M), Arginine (R) or threonine (T). In one example, a CDRL3 set forth in SEQ ID NO:881 is modified to contain one or more mutations at positions R91, S92, N93 and/or W94, based on kabat numbering. For example, exemplary of such amino acid replacements include R91P, R91L, R91G, S92P, S92A, S92Q, S92V, S92T, S92R, S92G, S92V, S92M, S92N, S92C, N93Y, N93S, N93H, N93Q, W94R, W94S, W94T, W94L, W94P and/or W94M. In another example, CDRL3 set forth in SEQ ID NO:882 is modified to contain one or more mutations at positions V89, L90, Y91, M92, G93, S94, G95, I95a and/or S95b, based on kabat numbering. For example, exemplary of such amino acid replacements include V89A, V89P, V89T, V89S, V89L, V89R, V89C, V89E, V89W, V89N, V89I, V89G, V89H, L90A, Y91A, M92A, M92E, M92S, M92G, M92L, M92P, M92V, M92D, M92R, M92N, M92T, M92F, G93A, S94A, S94W, S94G, S94P, S94R, S94L, S94M, S94E, S94V, G94A, I95aA, S95bA. The CDRL3 can contain 1, 2, 3, 4, 5, 6, 7, 8. 9 or more amino acid modifications. Exemplary modifications in CDRL3 set forth in SEQ ID NO:882 include, for example, M92R/S94M and/or V89L/S94P.

Exemplary of anti-DLL4 antibodies provided herein are antibodies set forth in in each row of Table 8a, each containing a variable heavy chain containing the specified amino acid replacement in CDRH1, CDRH2 and/or CDRH3 and a variable light chain containing the specified amino acid replacement in CDRL1, CDRL2 and/or CDRL3. Where no amino acid modification is indicated, the antibody contains the CDR sequence of the reference antibody. In the Table, the modifications are exemplified with respect to kabat numbering corresponding to a reference CDR sequence having a sequence of amino acids indicated by a SEQ ID NO. In parenthesis, the modifications are exemplified based on their amino acid position in the respective SEQ ID NO.

TABLE 8A

| CDRH1 GYTFTSYYMH (SEQ ID NO: 830) | CDRH2 IINPSGGSTSYAQKFQG (SEQ ID NO: 844) | CDRH3 EEYSSSSAEYFQH SEQ ID NO: 851 | CDRL1 RASQSVSSYLA (SEQ ID NO: 861) | CDRL2 DASNRAT (SEQ ID NO: 871) | CDRL3 QQRSNWPPWT (SEQ ID NO: 881) |
|---|---|---|---|---|---|
| 1 | | S100F (S104F) | | | |
| 2 | | S99P (S103P) | | | |
| 3 | | S98F (S102A) | | | |

TABLE 8A-continued

| | | | | | | |
|---|---|---|---|---|---|---|
| 4 | | S98A/S99P/S100F (S102A/S103P/S104F) | | | | |
| 5 | | S98A/S99P/S100F/H102Y (S102A/S103P/S104F/H111Y) | | | | |
| 6 | | S98A/S99P/S100F/H102F (S102A/S103P/S104F/H111F) | | | | |
| 7 | | S98A/S99P/S100F/H102F (S102A/S103P/S104F/H111F) | S31K (S31K) | | | |
| 8 | | S98A/S99P/S100F/H102F (S102A/S103P/S104F/H111F) | S28N/S30D/S31H (S28N/S30D/S31H) | | | |
| 9 | G55H (G56H) | S98A/S99P/S100F/H102F (S102A/S103P/S104F/H111F) | | | | |
| 10 | I51V/N52L/S53S/G55H (I51V/N52L/S54T/G56H) | S98A/S99P/S100F/H102F (S102A/S103P/S104F/H111F) | S28N/S30D/S31H (S28N/S30D/S31H) | | | |
| 11 | I51V/N52L/S53S/G55H (I51V/N52L/S54T/G56H) | S98A/S99P/S100F/H102F (S102A/S103P/S104F/H111F) | S28N/S30D/S31H (S28N/S30D/S31H) | S52L/A55S (S52L/A55S) | | |

| CDRH1 GYSFTSYWIG (SEQ ID NO: 831) | CDRH2 IIYPGDSDTRYSPSFQG (SEQ ID NO: 845) | CDRH3 RGYSYGYDYFDY (SEQ ID NO: 852) | CDRL1 GLSSGSVSTSYYP (SEQ ID NO: 862) | CDRL2 STNTRSS (SEQ ID NO: 872) | CDRL3 VLYMGSGISYV (SEQ ID NO: 882) |
|---|---|---|---|---|---|
| 12 | | G96K/G100T (G100K/G104T) | | | |
| 13 S28R (S28R) | | G96K/G100T (G100K/G104T) | | | |
| 14 S28R/G35V (S28R/G35V) | | G96K/G100T (G100K/G104T) | | | |
| 15 S28R/G35V (S28R/G35V) | | G96K/G100T (G100K/G104T) | | | M92R/S94M (M94R/S96M) |
| 16 S28R/G35V (S28R/G35V) | | G96K/G100T (G100K/G104T) | | | V89L/S94P (V91L/S96P) |
| 17 S28R/G35V (S28R/G35V) | | G96K/G100T (G100K/G104T) | | S50G (S52G) | V89L/S94P (V91L/S96P) |

In any of the above anti-DLL4 antibodies provided herein that contain one or more CDRs, the antibody further can contain one or more amino acid modifications to a framework region of the variable heavy or light chain. The mutations can be any amino acid addition, deletion or substitution. Generally, as described in Section D below, any further modification is one that is identified as contributing to an improved property to the antibody. Exemplary of a modification in a variable heavy chain is amino acid replacement at position 24 and/or 82a based on kabat numbering. For example, exemplary modifications include amino acid replacement of G24A, G24L, G24S, G24R, G24T, S82aV, S82aL, S82aG, S82aQ, S82aN, S82aH, S82aR, S82aK and/or S82aT, based on kabat numbering. For example, exemplary modifications include G24T, G24L G24A, and/or S82aT. Exemplary of a modification in a variable light chain is amino acid replacement at position 62, 76 based on kabat numbering. For example, exemplary modifications include amino acid replacement of F62L, S76E, S76Q, S76P, S76L, S76T, S76G, S76A, S76Y, S76N, T76S, T76E, T76Y and/or T76M. For example, exemplary modifications include T76E, T76Y or T76M. An exemplary combination modification includes amino acid replacement of S28R/G35V in CDRH1 set forth in SEQ ID NO:831, and additionally a modification of G24T, G24A or G24L.

In some examples, any of the above anti-DLL4 antibodies that contain one or more CDRs, or modified forms thereof, can be in a germline-derived antibody or a modified germline-derived antibody as described in Section.C.1 above. For example, exemplary anti-DLL4 antibodies that contain one or more CDRs, or modified forms thereof, provided herein include any that have a variable heavy chain set forth in SEQ ID NOS: 151-263, 381-438, and 894-898 and/or a variable light chain set forth in SEQ ID NOS: 264-380, 439-571.

In particular, provided herein are antibodies with nanomolar binding affinity for DLL4. These include, but are not limited to, anti-DLL4 antibodies set forth in Table 32. Exemplary antibodies include antibodies that have a variable heavy and light chain sequence set forth in SEQ ID NOS: 384 and 142; 414 and 142; 433 and 142; 433 and 479; 433 and 537; 433 and 536; 131 and 141; 151 and 141; 155 and 141; 156 and 141; 157 and 141; 155 and 266; 219 and 141; 156 and 343; 239 and 343; 239 and 370; and 134 and 147.

D. Further Modifications

The anti-DLL4 antibodies provided herein can be further modified. Modification of an anti-DLL4 antibody can improve one or more properties of the antibody, including, but not limited to, decreasing the immunogenicity of the antibody; improving the half-life of the antibody, such as as reducing the susceptibility to proteolysis and/or reducing susceptibility to oxidation; altering or improving of the binding properties of the antibody; and/or modulating the effector functions of the antibody. Exemplary modifications include modification of the primary sequence of the antibody and/or alteration of the post-translational modification of an antibody. Exemplary post-translational modifications include, for example, glycosylation, acetylation, pegylation, phosphorylation, amidation, derivatization with protecting/blocking group, proteolytic cleavage, and linkage to a cellular ligand or other protein. Other exemplary modifications include attachment of one or more heterologous peptides to the antibody to alter or improve one or more properties of the antibody.

Generally, the modifications do not result in increased immunogenicity of the antibody or antigen-binding fragment thereof or significantly negatively affect the binding of the antibody to DLL4. Methods of assessing the binding of the modified antibodies to DLL4 are provided herein and are known in the art. For example, modified antibodies can be assayed for binding to DLL4 by methods such as, but not limited to, ELISA or FACS binding assays.

Modification of the anti-DLL4 antibodies produced herein can include one or more amino acid substitutions, deletions or additions, either from natural mutation or human manipulation from the parent antibody from which it was derived. Methods for modification of polypeptides, such as antibodies, are known in the art and can be employed for the modification of any antibody or antigen-binding fragment provided herein. In some examples, the pharmacokinetic properties of the anti-DLL4 antibodies provided can be enhanced through Fc modifications by techniques known to those skilled in the art. Standard techniques known to those of skill in the art can be used to introduce mutations in the nucleotide molecule encoding an antibody or an antigen-binding fragment provided herein in order to produce a polypeptide with one or more amino acid substitutions. Exemplary techniques for introducing mutations include, but are not limited to, site-directed mutagenesis and PCR-mediated mutagenesis.

The anti-DLL4 antibodies provided herein can be modified by either N-linked or O-linked glycosylation. N-linked glycosylation includes the attachment of a carbohydrate moiety to the side chain of an asparagine residue within the tripeptide sequences asparagine-X-serine and asparagine-X-threonine, where X is any amino acid except proline. O-linked glycosylation includes the attachment of one of the sugars N-aceyl-galactosamine, galactose, or xylose to a hydroxyamino acid, most commonly serine or threonine, although 5-hydroxyproline or 5-hydroxylysine can also be used. The anti-DLL4 antibodies can be further modified to incorporate additional glycosylation sites by altering the amino acid sequence such that it contains one or more of the above-described tripeptide sequences (for N-linked glycosylation sites). The alteration can also be made by the addition of, or substitution by, one or more serine or threonine residues to the sequence of the original antibody (for O-linked glycosylation sites). Where the antibody comprises an Fc region, the carbohydrate attached thereto can be altered (see, e.g., U.S. Patent Pub. Nos. 2003/0157108, 2005/0123546 and US 2004/0093621; International Patent Pub. Nos. WO 2003/011878, WO 1997/30087, WO 1998/58964, WO 1999/22764; and U.S. Pat. No. 6,602,684).

For example, a glycosylation variation is in the Fc region of the antibody, wherein a carbohydrate structure attached to the Fc region lacks fucose. Such variants have improved ADCC function. Optionally, the Fc region further contains one or more amino acid substitutions therein which further improve ADCC, for example, substitutions at positions 298, 333, and/or 334 of the Fc region (Eu numbering of residues) (see, e.g., US 2003/0157108; WO 2000/61739; WO 2001/29246; US 2003/0115614; US 2002/0164328; US 2004/0093621; US 2004/0132140; US 2004/0110704; US 2004/0110282; US 2004/0109865; WO 2003/085119; WO 2003/084570; WO 2005/035586; WO 2005/035778; WO2005/053742; Okazaki et al. *J. Mol. Biol.* 336:1239-1249 (2004); Yamane-Ohnuki et al. *Biotech. Bioeng.* 87: 614 (2004)). Examples of cell lines producing defucosylated antibodies include Lec13 CHO cells deficient in protein fucosylation (Ripka et al. *Arch. Biochem. Biophys.* 249:533-545 (1986); US Pat Appl No US 2003/0157108 A1, Presta, L; and WO 2004/056312 A1, Adams et al., especially at Example 11), and knockout cell lines, such as alpha-1,6-fucosyltransferase gene, FUT8, knockout CHO cells (Yamane-Ohnuki et al. *Biotech. Bioeng.* 87: 614 (2004)).

The anti-DLL4 antibodies provided herein can be modified by the attachment of a heterologous peptide to facilitate purification. Generally such peptides are expressed as a fusion protein containing the antibody fused to the peptide at the C- or N-terminus of the antibody. Exemplary peptides commonly used for purification include, but are not limited to, hexa-histidine peptides, (SEQ ID NO: 906) hemagglutinin (HA) peptides, and flag tag peptides (see e.g., Wilson et al. (1984) *Cell* 37:767; Witzgall et al. (1994) *Anal Biochem* 223:2, 291-8). The fusion does not necessarily need to be direct, but can occur through a linker peptide. In some examples, the linker peptide contains a protease cleavage site which allows for removal of the purification peptide following purification by cleavage with a protease that specifically recognizes the protease cleavage site.

The anti-DLL4 antibodies and fragments thereof provided herein also can be modified by the attachment of a heterologous polypeptide that targets the antibody or antigen-binding fragment to a particular cell type, either in vitro or in vivo. In some examples an anti-DLL4 antibody provided herein can be targeted to a particular cell type by fusing or conjugating the antibody to an antibody specific for a particular cell surface receptors or other polypeptide that interacts with a specific cell receptor. Various other heterologous polypeptides can be attached to an anti-DLL4 antibody or fragment thereof, including those which increase the serum half-life of the antibody and/or enzymes (e.g., for ADEPT).

The anti-DLL4 antibodies provided herein can be modified by the attachment of diagnostic and/or therapeutic moiety to the antibody. The anti-DLL4 antibodies provided herein can be modified by the covalent attachment of any type of molecule, such as a diagnostic or therapeutic molecule, to the antibody such that covalent attachment does not prevent the antibody from binding to its corresponding epitope. For example, an anti-DLL4 antibody provided herein can be further modified by covalent attachment of a molecule such that the covalent attachment does not prevent the antibody from binding to DLL4. In some examples, the antibodies can be recombinantly fused to a heterologous polypeptide at the N-terminus or C-terminus or chemically conjugated, including covalent and non-covalent conjugation, to a heterologous polypeptide or other composition. For example, the heterologous polypeptide or composition can be a diagnostic polypeptide or other diagnostic moiety or a therapeutic polypeptide or other therapeutic moiety. Exemplary diagnostic and therapeutic moieties include, but are not limited to, drugs, radionucleotides, toxins, fluorescent molecules (see, e.g. International PCT Publication Nos. WO 92/08495; WO 91/14438; WO 89/12624; U.S. Pat. No. 5,314,995; and EP 396,387). Diagnostic polypeptides or diagnostic moieties can be used, for example, as labels for in vivo or in vitro detection.

Additional fusion proteins of the anti-DLL4 antibodies provided herein can be generated through the techniques of gene-shuffling, motif-shuffling, exon-shuffling, and/or codon-shuffling (collectively referred to as "DNA shuffling"). DNA shuffling can be employed to alter the activities of anti-DLL4 antibodies provided herein, for example, to produce antibodies with higher affinities and lower dissociation rates (see, generally, U.S. Pat. Nos. 5,605,793; 5,811,238; 5,830,721; 5,834,252; and 5,837,458, and Patten et al. (1997) *Curr. Opinion Biotechnol.* 8:724-33; Harayama (1998) *Trends Biotechnol.* 16(2):76-82; Hansson et al., (1999) *J. Mol. Biol.* 287:265-76; and Lorenzo and Blasco (1998) *Biotechniques* 24(2):308-13).

1. Modifications to Reduce Immunogenicity

In some examples, the antibodies provided herein can be further modified to reduce the immunogenicity in a subject, such as a human subject. For example, one or more amino acids in the antibody can be modified to alter potential epitopes for human T-cells in order to eliminate or reduce the immunogenicity of the antibody when exposed to the immune system of the subject. Exemplary modifications include substitutions, deletions and insertion of one or more amino acids, which eliminate or reduce the immunogenicity of the antibody. Generally, such modifications do not alter the binding specificity of the antibody for its respective antigen. Reducing the immunogenicity of the antibody can improve one or more properties of the antibody, such as, for example, improving the therapeutic efficacy of the antibody and/or increasing the half-life of the antibody in vivo.

2. Fc Modifications

The anti-DLL4 antibodies provided herein can contain wild-type or modified Fc region. In some examples, the Fc region can be modified to alter one or more properties of the Fc polypeptide. For example, the Fc region can be modified to alter (i.e. increase or decrease) effector functions compared to the effector function of an Fc region of a wild-type immunoglobulin heavy chain. The Fc region of an antibody interacts with a number of Fc receptors, and ligands, imparting an array of important functional capabilities referred to as effector functions. Fc effector functions include, for example, Fc receptor binding, complement fixation, and T cell depleting activity (see e.g., U.S. Pat. No. 6,136,310). Methods of assaying T cell depleting activity, Fc effector function, and antibody stability are known in the art. For example, the Fc region of an IgG molecule interacts with the FcγRs. These receptors are expressed in a variety of immune cells, including for example, monocytes, macrophages, neutrophils, dendritic cells, eosinophils, mast cells, platelets, B cells, large granular lymphocytes, Langerhans' cells, natural killer (NK) cells, and γδ T cells. Formation of the Fc/FcγR complex recruits these effector cells to sites of bound antigen, typically resulting in signaling events within the cells and important subsequent immune responses such as release of inflammation mediators, B cell activation, endocytosis, phagocytosis, and cytotoxic attack. The ability to mediate cytotoxic and phagocytic effector functions is a potential mechanism by which antibodies destroy targeted cells. Recognition of and lysis of bound antibody on target cells by cytotoxic cells that express FcγRs is referred to as antibody dependent cell-mediated cytotoxicity (ADCC). Other Fc receptors for various antibody isotypes include FcεRs (IgE), FcαRs (IgA), and FcμRs (IgM).

Thus, a modified Fc domain can have altered affinity, including but not limited to, increased or low or no affinity for the Fc receptor. For example, the different IgG subclasses have different affinities for the FcγRs, with IgG1 and IgG3 typically binding substantially better to the receptors than IgG2 and IgG4. In addition, different FcγRs mediate different effector functions. FcγR1, FcγRIIa/c, and FcγRIIIa are positive regulators of immune complex triggered activation, characterized by having an intracellular domain that has an immunoreceptor tyrosine-based activation motif (ITAM). FcγRIIb, however, has an immunoreceptor tyrosine-based inhibition motif (ITIM) and is therefore inhibitory. Thus, altering the affinity of an Fc region for a receptor can modulate the effector functions induced by the Fc domain.

In one example, an Fc region is used that is modified for optimized binding to certain FcγRs to better mediate effector functions, such as for example, antibody-dependent cellular cytotoxicity, ADCC. Such modified Fc regions can contain modifications at one or more of amino acid residues (according to the Kabat numbering scheme, Kabat et al. (1991) Sequences of Proteins of Immunological Interest, U.S. Department of Health and Human Services), including, but not limited to, amino acid positions 249, 252, 259, 262, 268, 271, 273, 277, 280, 281, 285, 287, 296, 300, 317, 323, 343, 345, 346, 349, 351, 352, 353, and 424. For example, modifications in an Fc region can be made corresponding to any one or more of G119S, G119A, S122D, S122E, S122N, S122Q, S122T, K129H, K129Y, D132Y, R138Y, E141Y, T143H, V147I, S150E, H151D, E155Y, E155I, E155H, K157E, G164D, E166L, E166H, S18IA, S181D, S187T, S207G, S2071, K209T, K209E, K209D, A210D, A213Y, A213L, A213I, I215D, I215E, I215N, I215Q, E216Y, E216A, K217T, K217F, K217A, and P279L of the exemplary Fc sequence set forth in SEQ ID NO:891, or combinations thereof. A modified Fc containing these mutations can have enhanced binding to an FcR such as, for example, the activating receptor FcγIIIa and/or can have reduced binding to the inhibitory receptor FcγRIIb (see e.g., US 2006/0024298). Fc regions modified to have increased binding to FcRs can be more effective in facilitating the destruction of the fungal cells in patients.

In some examples, the antibodies or antigen-binding fragments provided herein can be further modified to improve the interaction of the antibody with the FcRn receptor in order to increase the in vivo half-life and pharmacokinetics of the antibody (see, e.g. U.S. Pat. No. 7,217,797; and U.S. Pat. Pub. Nos. 2006/0198840 and 2008/0287657). FcRn is the neonatal FcR, the binding of which recycles endocytosed antibody from the endosomes back to the bloodstream. This process, coupled with preclusion of kidney filtration due to the large size of the full length molecule, results in favorable antibody serum half-lives ranging from one to three weeks. Binding of Fc to FcRn also plays a role in antibody transport.

Exemplary modifications of the Fc region include but are not limited to, mutation of the Fc described in U.S. Pat. No. 7,217,797; U.S. Pat. Pub. Nos. 2006/0198840, 2006/0024298 and 2008/0287657; and International Patent Pub. No. WO 2005/063816, such as mutations at one or more of amino acid residues (Kabat numbering, Kabat et al. (1991)) 251-256, 285-90, 308-314, in the $C_H2$ domain and/or amino acids residues 385-389, and 428-436 in the $C_H3$ domain of the Fc heavy chain constant region, where the modification alters Fc receptor binding affinity and/or serum half-life relative to unmodified antibody. In some examples, the Fc region is modified at one or more of amino acid positions 250, 251, 252, 254, 255, 256, 263, 308, 309, 311, 312 and 314 in the $C_H2$ domain and/or amino acid positions 385, 386, 387, 389, 428, 433, 434, 436, and 459 in the $C_H3$ domain of the Fc heavy chain constant region. Such modifications correspond to amino acids Gly120, Pro121, Ser122, Phe124 Leu125, Phe126, Thr133, Pro174, Arg175, Glu177, Gln178, and Asn180 in the $C_H2$ domain and amino acids Gln245, Val246, Ser247, Thr249, Ser283, Gly285, Ser286, Phe288, and Met311 in the $C_H3$ domain in an exemplary Fc sequence set forth in SEQ ID NO:891 In some examples, the modification is at one or more surface-exposed residues, and the modification is a substitution with a residue of similar charge, polarity or hydrophobicity to the residue being substituted.

In particular examples, a Fc heavy chain constant region is modified at one or more of amino acid positions 251, 252, 254, 255, and 256 (Kabat numbering), where position 251 is substituted with Leu or Arg, position 252 is substituted with Tyr, Phe, Ser, Trp or Thr, position 254 is substituted with Thr or Ser, position 255 is substituted with Leu, Gly, Ile or Arg, and/or position 256 is substituted with Ser, Arg, Gln, Glu, Asp, Ala, Asp or Thr. In some examples, a Fc heavy chain constant region is modified at one or more of amino acid positions 308, 309, 311, 312, and 314 (Kabat numbering), where position 308 is substituted with Thr or Ile, position 309 is substituted with Pro, position 311 is substituted with serine or Glu, position 312 is substituted with Asp, and/or position 314 is substituted with Leu. In some examples, a Fc heavy chain constant region is modified at one or more of amino acid positions 428, 433, 434, and 436 (Kabat numbering), where position 428 is substituted with Met, Thr, Leu, Phe, or Ser, position 433 is substituted with Lys, Arg, Ser, Ile, Pro, Gln, or His, position 434 is substituted with Phe, Tyr, or His, and/or position 436 is substituted with His, Asn, Asp, Thr, Lys, Met, or Thr. In some examples, a Fc heavy chain constant region is modified at one or more of amino acid positions 263 and 459 (Kabat numbering), where position 263 is substituted with Gln or Glu and/or position 459 is substituted with Leu or Phe.

In some examples, a Fc heavy chain constant region can be modified to enhance binding to the complement protein C1q. In addition to interacting with FcRs, Fc also interact with the complement protein C1q to mediate complement dependent cytotoxicity (CDC). C1q forms a complex with the serine proteases C1r and C1s to form the C1 complex. C1q is capable of binding six antibodies, although binding to two IgGs is sufficient to activate the complement cascade. Similar to Fc interaction with FcRs, different IgG subclasses have different affinity for C1q, with IgG1 and IgG3 typically binding substantially better than IgG2 and IgG4. Thus, a modified Fc having increased binding to C1q can mediate enhanced CDC, and can enhance destruction of fungal cells. Exemplary modifications in an Fc region that increase binding to C1q include, but are not limited to, amino acid modifications at positions 345 and 253 (Kabat numbering). Exemplary modifications are include those corresponding to K209W, K209Y, and E216S in an exemplary Fc sequence set forth in SEQ ID NO:891.

In another example, a variety of Fc mutants with substitutions to reduce or ablate binding with FcγRs also are known. Such muteins are useful in instances where there is a need for reduced or eliminated effector function mediated by Fc. This is often the case where antagonism, but not killing of the cells bearing a target antigen is desired. Exemplary of such an Fc is an Fc mutein described in U.S. Pat. No. 5,457,035, which is modified at amino acid positions 248, 249 and 251 (Kabat numbering). In an exemplary Fc sequence set forth in amino acids 100-330 of SEQ ID NO:891, amino acid 118 is modified from Leu to Ala, amino acid 119 is modified from Leu to Glu, and amino acid 121 is modified from Gly to Ala. Similar mutations can be made in any Fc sequence such as, for example, the exemplary Fc sequence. This mutein exhibits reduced affinity for Fc receptors.

The antibodies provided herein can be engineered to contain modified Fc regions. For example, methods for fusing or conjugating polypeptides to the constant regions of antibodies (i.e. making Fc fusion proteins) are known in the art and described in, for example, U.S. Pat. Nos. 5,336,603, 5,622,929, 5,359,046, 5,349,053, 5,447,851, 5,723,125, 5,783,181, 5,908,626, 5,844,095, and 5,112,946; EP 307,434; EP 367,166; EP 394,827; PCT publications WO 91/06570, WO 96/04388, WO 96/22024, WO 97/34631, and WO 99/04813; Ashkenazi et al. (1991) *Proc. Natl. Acad. Sci. USA* 88:10535-10539; Traunecker et al. (1988) Nature 331:84-86; Zheng et al. (1995) *J. Immunol.* 154:5590-5600; and Vil et al. (1992) *Proc. Natl. Acad. Sci. USA* 89:11337-11341 (1992) and described elsewhere herein. In some examples, a modified Fc region having one or more modifications that increases the FcRn binding affinity and/or improves half-life can be fused to an anti-DLL4 antibody provided herein.

3. Pegylation

The anti-DLL4 antibodies provided herein can be conjugated to polymer molecules, or water soluble polymers, such as high molecular weight polyethylene glycol (PEG) to increase half-life and/or improve their pharmacokinetic profiles. Water soluble polymers include, but are not limited to, polyethylene glycol (PEG), copolymers of ethylene glycol/propylene glycol, carboxymethylcellulose, dextran, polyvinyl alcohol, polyvinyl pyrrolidone, poly-1,3-dioxolane, poly-1,3,6-trioxane, ethylene/maleic anhydride copolymer, polyaminoacids (either homopolymers or random copolymers), and dextran or poly(n-vinyl pyrrolidone)polyethylene glycol, propropylene glycol homopolymers, prolypropylene oxide/ethylene oxide co-polymers, polyoxyethylated polyols (e.g., glycerol), polyvinyl alcohol, and mixtures thereof. Polyethylene glycol propionaldehyde can have advantages in manufacturing due to its stability in water. The polymer can be of any molecular weight, and can be branched or unbranched. The number of polymers attached to the antibody can vary, and if more than one polymers are attached, they can be the same or different molecules. In general, the number and/or type of polymers used for derivatization can be determined based on considerations including, but not limited to, the particular properties or functions of the antibody to be improved, and whether the antibody derivative will be used in a therapy under defined conditions.

Conjugation can be carried out by techniques known to those skilled in the art. Conjugation of therapeutic antibodies with PEG has been shown to enhance pharmacodynamics while not interfering with function (see, e.g., Deckert et al., *Int. J. Cancer* 87: 382-390, 2000; Knight et al., *Platelets* 15: 409-418, 2004; Leong et al., *Cytokine* 16: 106-119, 2001; and Yang et al., *Protein Eng.* 16: 761-770, 2003). PEG can be attached to the antibodies or antigen-binding fragments with or without a multifunctional linker either through site-specific conjugation of the PEG to the N- or C-terminus of the antibodies or antigen-binding fragments or via epsilon-amino groups present on lysine residues. Linear or branched polymer derivatization that results in minimal loss of biological activity can be used. The degree of conjugation can be monitored by SDS-PAGE and mass spectrometry to ensure proper conjugation of PEG molecules to the antibodies. Unreacted PEG can be separated from antibody-PEG conjugates by, e.g., size exclusion or ion-exchange chromatography. PEG-derivatized antibodies can be tested for binding activity to DLL4 as well as for in vivo efficacy using methods known to those skilled in the art, for example, by functional assays described herein.

4. Conjugation of a Detectable Moiety

In some examples, the anti-DLL4 antibodies and antibody fragments provided herein can be further modified by conjugation to a detectable moiety. The detectable moieties can be detected directly or indirectly. Depending on the detectable moiety selected, the detectable moiety can be detected in vivo and/or in vitro. The detectable moieties can be employed, for example, in binding assays for determining the binding affinity of the anti-DLL4 antibody for DLL4. The detectable moieties also can be employed in methods of preparation of the anti-DLL4 antibodies, such as, for example, purification of the antibody. Typically, detectable moieties are selected such that conjugation of the detectable moiety does not interfere with the binding of the antibody to the target epitope. Generally, the choice of the detectable moiety depends on sensitivity required, ease of conjugation with the compound, stability requirements, available instrumentation, and disposal provisions. One of skill in the art is familiar with labels and can identify a detectable label suitable for and compatible with the assay employed. Methods of labeling antibodies with detectable moieties are known in the art and include, for example, recombinant and chemical methods.

The detectable moiety can be any material having a detectable physical or chemical property. Such detectable labels have been well-developed in the field of immunoassays and, in general, most any label useful in such methods can be applied in the methods provided. Thus, a label is any composition detectable by spectroscopic, photochemical, biochemical, immunochemical, electrical, optical or chemical means. Useful labels include, but are not limited to, fluorescent dyes (e.g., fluorescein isothiocyanate, Texas red, rhodamine, and the like), radiolabels (e.g., $^3$H, $^{125}$I, $^{35}$S, $^{14}$C, or $^{32}$P), in particular, gamma and positron emitting radioisotopes (e.g., $^{157}$Gd, $^{55}$Mn, $^{162}$Dy, $^{52}$Cr, and $^{56}$Fe), metallic ions (e.g., $^{111}$In, $^{97}$Ru, $^{67}$Ga, $^{68}$Ga, $^{72}$As, $^{89}$Zr, and $^{201}$Ti), enzymes (e.g., horse radish peroxidase, alkaline phosphatase and others commonly used in an ELISA), electron transfer agents (e.g., including metal binding proteins and compounds); luminescent and chemiluminescent labels (e.g., luciferin and 2,3-dihydrophtahlazinediones, e.g., luminol), magnetic beads (e.g., DYNABEADS™), and colorimetric labels such as colloidal gold or colored glass or plastic beads (e.g., polystyrene, polypropylene, latex, etc.). For a review of various labeling or signal producing systems that can be used, see e.g. U.S. Pat. No. 4,391,904.

5. Modifications to Improve Binding Specificity

The binding specificity of the anti-DLL4 antibodies and antibody fragments provided can be altered or improved by techniques, such as phage display, which are described in further detail elsewhere herein. Methods for phage display generally involve the use of a filamentous phage (phagemid) surface expression vector system for cloning and expressing antibody species of the library. Various phagemid cloning systems to produce combinatorial libraries have been described by others. See, for example the preparation of combinatorial antibody libraries on phagemids as described by Kang, et al., *Proc. Natl. Acad. Sci., USA,* 88:4363-4366 (1991); Barbas, et al., *Proc. Natl. Acad. Sci., USA,* 88:7978-7982 (1991); Zebedee, et al., *Proc. Natl. Acad. Sci., USA,* 89:3175-3179 (1992); Kang, et al., *Proc. Natl. Acad. Sci., USA,* 88:11120-11123 (1991); Barbas, et al., *Proc. Natl. Acad. Sci., USA,* 89:4457-4461 (1992); and Gram, et al., *Proc. Natl. Acad. Sci., USA,* 89:3576-3580 (1992), which references are hereby incorporated by reference.

In particular examples, DNA sequences encoding $V_H$ and $V_L$ domains are amplified from animal cDNA libraries (e.g., human or murine cDNA libraries of lymphoid tissues). The DNA encoding the $V_H$ and $V_L$ domains are recombined together with an scFv linker by PCR and cloned into a phagemid vector (e.g., p CANTAB 6 or pComb 3 HSS). The vector is electroporated in *E. coli* and the *E. coli* is infected with helper phage. Phage used in these methods are typically filamentous phage including fd and M13 and the $V_H$ and $V_L$ domains are usually recombinantly fused to either the phage gene III or gene VIII. Phage expressing an antigen-binding domain that binds to a DLL4 antigen can be selected or identified with antigen, e.g., recombinant DLL4. Examples of phage display methods that can be used to make the antibodies by phage display include those disclosed, for example, in Brinkman et al. (1995) *J. Immunol. Methods* 182:41-50; Ames et al. (1995) *J. Immunol. Methods* 184:177-186; Kettleborough et al. (1994) *Eur. J. Immunol.* 24:952-958; Persic et al. (1997) *Gene* 187:9-18; Burton et al. (1994) *Advances in Immunology* 57:191-280; PCT application No. PCT/GB91/O1 134; PCT publication Nos. WO 90/02809, WO 91/10737, WO 92/01047, WO 92/18619, WO 93/1 1236, WO 95/15982, WO 95/20401, and WO97/13844; and U.S. Pat. Nos. 5,698,426, 5,223,409, 5,403,484, 5,580,717, 5,427,908, 5,750,753, 5,821,047, 5,571,698, 5,427,908, 5,516,637, 5,780,225, 5,658,727, 5,733,743 and 5,969,108; each of which is incorporated herein by reference in its entirety.

As described in the above references, after phage selection, the antibody coding regions from the phage can be isolated and used to generate whole antibodies, including human antibodies, or any other desired antigen-binding fragment, and expressed in any desired host, including mammalian cells, insect cells, plant cells, yeast, and bacteria, e.g., as described herein. Techniques to recombinantly produce Fab, Fab' and F(ab')2 fragments can also be employed using methods known in the art such as those disclosed in PCT publication No. WO 92/22324; Mullinax et al. (1992) *Bio Techniques* 12(6):864-869; Sawai et al. (1995) *AJRI* 34:26-34; and Better et al. (1988) *Science* 240: 1041-1043.

The resulting phagemid library can be manipulated to increase and/or alter the immunospecificities of the antibodies or antibody fragment of the library to produce and subsequently identify additional antibodies with improved properties, such as increased binding to a target antigen. For example, either or both the H and L chain encoding DNA can be mutagenized in a complementarity determining region (CDR) of the variable region of the immunoglobulin polypeptide, and subsequently screened for desirable immunoreaction and neutralization capabilities. In order to identify candidate hypervariable region sites for modification, alanine scanning mutagenesis can be performed to identify hypervariable region residues contributing significantly to antigen binding. Alternatively, or additionally, it can be beneficial to analyze a crystal structure of the antigen-antibody complex to identify contact points between the antibody and antigen. Such contact residues and neighboring residues are candidates for substitution according to the techniques elaborated herein. Once such variants are generated, the panel of variants is subjected to screening as described herein and antibodies with superior properties in one or more relevant assays can be selected for further development.

E. Methods of Generating or Identifying Anti-DLL4 Antibodies

Anti-DLL4 antibodies provided herein an be generated or identified using any method known to one of skill in the art. For example, an anti-DLL4 antibody can be generated using conventional immunization and hybridoma screening methods. In other examples, an anti-DLL4 antibody is identified by any of a variety of screening methods known to one of skill in the art, such as any described herein. Identified or generated antibodies also can be further optimized using antibody engineering and affinity maturation methods.

1. Immunization and Hybridoma Screening

Antibodies specific for DLL4 can be made using the hybridoma method first described by Kohler et al. (1975) *Nature,* 256:495, or made by recombinant DNA methods (U.S. Pat. No. 4,816,567).

In the hybridoma method, a mouse or other appropriate host animal, such as a hamster, is immunized to elicit lymphocytes that produce or are capable of producing antibodies that will specifically bind to the protein used for immunization. Antibodies to a target antigen can be raised in animals by multiple subcutaneous (sc) or intraperitoneal (ip) injections of protein antigen and an adjuvant. Two weeks later, animals are boosted. 7 to 14 days later animals are bled and the serum is assayed for antibody titer specific for the target antigen. Animals are boosted until titers plateau.

Alternatively, lymphocytes can be immunized in vitro. Lymphocytes then are fused with myeloma cells using a suitable fusing agent, such as polyethylene glycol, to form a hybridoma cell (Goding, Monoclonal Antibodies: Principles and Practice, pp. 59-103 (Academic Press, 1986)).

The hybridoma cells that are prepared are seeded and grown in a suitable culture medium that generally contains one or more substances that inhibit the growth or survival of the unfused, parental myeloma cells. For example, if the parental myeloma cells lack the enzyme hypoxanthine guanine phosphoribosyl transferase (HGPRT or HPRT), the culture medium for the hybridomas typically will include hypoxanthine, aminopterin, and thymidine (HAT medium), which substances prevent the growth of HGPRT-deficient cells.

Myeloma cells include those that fuse efficiently, support stable high-level production of antibody by the selected antibody-producing cells, and are sensitive to a medium such as HAT medium. Among these, myeloma cell lines are murine myeloma lines, such as those derived from MOPC-21 and MPC-11 mouse tumors available from the Salk Institute Cell Distribution Center, San Diego, Calif., USA, and SP-2 or X63-Ag8-653 cells available from the American Type Culture Collection (ATCC), Rockville, Md., USA. Human myeloma and mouse-human heterocyeloma cells lines also have been described for the production of human monoclonal antibodies (Kozbor, (1984) *J. Immunol.*, 133:3001; and Brodeur et al., Monoclonal Antibody Production Techniques and Applications, pp. 51-63 (Marcel Dekker, Inc., New York, 1987)).

Culture medium in which hybridoma cells are growing is assayed for production of monoclonal antibodies directed against the target antigen. The binding specificity of monoclonal antibodies produced by hybridoma cells can be determined by any method known to one of skill in the art (e.g. as described in Section E.1), for example, by immunoprecipitation or by an in vitro binding assay, such as radioimmunoassay (RIA) or enzyme-linked immunoabsorbent assay (ELISA). The binding affinity also can be determined, for example, using Scatchard analysis.

After hybridoma cells are identified that produce antibodies of the desired specificity, affinity, and/or activity, the clones can be subcloned by limiting dilution procedures and grown by standard methods (Goding, Monoclonal Antibodies: Principles and Practice, pp. 59-103 (Academic Press, 1986)). Suitable culture media for this purpose include, for example, D-MEM or RPMI-1640 medium. In addition, the hybridoma cells can be grown in vivo as ascites tumors in an animal.

The monoclonal antibodies secreted by the subclones are suitably separated from the culture medium, ascites fluid, or serum by conventional immunoglobulin purification procedures such as, for example, protein A-Sepharose, hydroxylapatite chromatography, gel electrophoresis, dialysis, or affinity chromatography.

DNA-encoding the hybridoma-derived monoclonal antibody can be readily isolated and sequenced using conventional procedures. For example, sequencing can be effected using oligonucleotide primers designed to specifically amplify the heavy and light chain coding regions of interest from the hybridoma. Once isolated, the DNA can be placed into expression vectors, which are then transfected into host cells such as *E. coli* cells, simian COS cells, Chinese hamster ovary (CHO) cells, or myeloma cells that do not otherwise produce immunoglobulin protein to obtain the synthesis of the desired monoclonal antibodies in the recombinant host cells.

2. Screening Assays

Anti-DLL4 antibodies can be identified using antibody libraries to screen for antibody clones with the desired activity or activities.

a. Display Libraries

Typical of screening methods are high throughput screening of antibody libraries. For example, antibody libraries are screened using a display technique, such that there is a physical link between the individual molecules of the library (phenotype) and the genetic information encoding them (genotype). These methods include, but are not limited to, cell display, including bacterial display, yeast display and mammalian display, phage display (Smith, G. P. (1985) *Science* 228:1315-1317), mRNA display, ribosome display and DNA display. Using display techniques, the identity of each of the individual antibodies is unknown prior to screening, but the phenotype-genotype link allows for facile identification of selected antibodies. Typically, in the libraries, nucleic acids encoding antibody gene fragments are obtained from immune cells harvested from humans or animals. If a library biased in favor of an antigen-specific antibody is desired, the subject is immunized with the target antigen to generate an antibody response, and spleen cells and/or circulating B cells or other peripheral blood lymphocytes (PBLs) are recovered for library construction. Additional enrichment for antigen-specific antibody reactive cell populations can be obtained using a suitable screening procedure to isolate B cells expressing antigen-specific membrane bound antibody, e.g. by cell separation with antigen affinity chromatography or adsorption of cells to fluorochrome-labeled antigen followed by fluorescence-activated cell sorting (FACs).

Alternatively, the use of spleen cells and/or B cells or other PBLs from an unimmunized donor provides a better representation of the possible antibody repertoire, and also permits the construction of an antibody library using any animal (human or non-human) species in which the target antigen is not antigenic. For libraries incorporating in vitro antibody gene construction, stem cells are harvested from the subject to provide nucleic acids encoding unrearranged antibody gene segments. The immune cells of interest can be obtained from a variety of animal species, such as human, mouse, rat, lagomorpha, lupine, canine, feline, porcine, bovine, equine, and avian species.

Nucleic acid encoding antibody variable gene segments (including VH and VL segments) can be recovered from the cells of interest and amplified. In the case of rearranged VH and VL gene libraries, the desired DNA can be obtained by isolating genomic DNA or mRNA from lymphocytes followed by polymerase chain reaction (PCR) with primers matching the 5' and 3' ends of rearranged VH and VL genes as described in Orlandi et al., (1989) *Proc. Natl. Acad. Sci. (USA)*, 86:3833-3837, thereby making diverse V gene repertoires for expression. The V genes can be amplified from cDNA and genomic DNA, with back primers at the 5' end of the exon encoding the mature V-domain and forward primers based within the J-segment as described in Orlandi et al., (1989) and in Ward et al., (1989) *Nature*, 341:544-546. For amplifying from cDNA, however, back primers can also be based in the leader exon as described in Jones et al., (1991) *Biotechnology*, 9:88-89, and forward primers within the constant region as described in Sastry et al., (1989) *Proc. Natl. Acad. Sci. (USA)*, 86:5728-5732. To maximize complementarity, degeneracy can be incorporated in the primers as described in Orlandi et al. (1989) or Sastry et al. (1989). The library diversity can be maximized by using PCR primers targeted to each V-gene family in order to amplify all available VH and VL arrangements present in the immune cell nucleic acid sample, e.g. as described in the method of Marks et al., (1991) *J. Mol. Biol.*, 222:581-597, or as described in the method of Orum et al., (1993) *Nucleic Acids Res.*, 21:4491-4498. For cloning of the amplified DNA into expression vectors, rare restriction sites can be introduced within the PCR primer as a tag at one end as described in Orlandi et al. (1989), or by further PCR amplification with a tagged primer as described in Clackson et al., (1991) *Nature*, 352:624-628.

In another example of generating an antibody library, repertoires of synthetically rearranged V genes can be derived in vitro from V gene segments. Most of the human VH-gene segments have been cloned and sequenced (see e.g. Tomlinson et al., (1992) *J. Mol. Biol.*, 227:776-798), and mapped (see e.g. Matsuda et al., (1993) *Nature Genet.*, 3:988-94). These segments can be used to generate diverse VH gene repertoires with PCR primers encoding H3 loops of diverse sequence and length as described in Hoogenboom and Winter (1992) *J. Mol. Biol.*, 227:381-388. VH repertoires also can be made with all of the sequence diversity focused in a long H3 loop of a single length as described in Barbas et al., (1992) *Proc. Natl. Acad. Sci. USA*, 89:4457-4461. Human Vκ and Vλ segments have been cloned and sequenced (see e.g. Williams and Winter (1993) *Eur. J. Immunol.*, 23:1456-1461) and can be used to make synthetic light chain repertoires. Synthetic V gene repertoires, based on a range of VH and VL folds, and L3 and H3 lengths, encode antibodies of considerable structural diversity. Following amplification of V-gene encoding DNAs, germline V-gene segments can be rearranged in vitro according to the methods of Hoogenboom and Winter (1992) *J. Mol. Biol.*, 227:381-388.

Repertoires of antibody fragments can be constructed by combining VH and VL gene repertoires together in several ways. Each repertoire can be created in different vectors, and the vectors recombined in vitro (see e.g. Hogrefe et al., (1993) *Gene*, 128:119-126), or in vivo by combinatorial infection, for example, using the lox P system (Waterhouse et al., (1993) *Nucl. Acids Res.*, 21:2265-2266). The in vivo recombination approach exploits the two-chain nature of Fab fragments to overcome the limit on library size imposed by *E. coli* transformation efficiency. Alternatively, the repertoires can be cloned sequentially into the same vector (see e.g. Barbas et al., (1991) *Proc. Natl. Acad. Sci. USA*, 88:7978-7982), or assembled together by PCR and then cloned (see e.g. Clackson et al., (1991) *Nature*, 352:624-628). PCR assembly can also be used to join VH and VL DNAs with DNA encoding a flexible peptide spacer to form single chain Fv (scFv) repertoires. In another technique, "in cell PCR assembly" can be used to combine VH and VL genes within lymphocytes by PCR and then clone repertoires of linked genes (see e.g. Embleton (1992) *Nucl. Acids Res.*, 20:3831-3837).

In typical display libraries, the repertoire of VH and VL chains are constructed as one-pot libraries, such that the sequence of each member of the library is not known. Accordingly, sequencing is required following identification of a antibody specific for DLL4. Thus, as above for hybridoma-generated antibodies, DNA-encoding antibody clones identified from a display library can be readily isolated and sequenced using conventional procedures. For example, sequencing can be effected using oligonucleotide primers designed to specifically amplify the heavy and light chain coding regions of interest from a DNA template, e.g. phage DNA template.

Exemplary of such antibody libraries that can be used for screening are those described in any of the following: European Patent Application Nos. EP0368684 and EP89311731; International Published Patent Application Nos. WO92/001047, WO 02/38756, WO 97/08320, WO 2005/023993, WO 07/137,616 and WO 2007/054816; U.S. Pat. No. 6,593,081 and U.S. Pat. No. 6,989,250; United States Published Patent Application Nos. US 2002/0102613, US 2003/153038, US 2003/0022240, US 2005/0119455, US 2005/0079574 and US 2006/0234302; and Orlandi et al. (1989) *Proc Natl. Acad. Sci. U.S.A.*, 86:3833-3837; Ward et al. (1989) *Nature*, 341:544-546; Huse et al. (1989) *Science*, 246: 1275-1281; Burton et al. (1991) *Proc. Natl. Acad. Sci., U.S.A.*, 88:10134-10137; Marks et al. (1991) *J Mol Biol*, 222:581-591; Hoogenboom et al. (1991) *J Mol Biol*, 227:381-388; Nissim et al. (1994) *EMBO J*, 13:692-698; Barbas et al. (1992) *Proc. Natl. Acad. Sci., U.S.A.*, 89:4457-4461; Akamatsu et al. (1993) *J. Immunol.*, 151:4651-1659; Griffiths et al. (1994) *EMBO J*, 13:3245-3260; Fellouse (2004) PNAS, 101:12467-12472; Persson et al. (2006) J. Mol. Biol. 357: 607-620; Knappik et al. (2000) J. Mol. Biol. 296:57-86; Rothe et al. (2008) J. Mol. Biol. 376:1182-1200; Mondon et al. (2008) *Frontiers in Bioscience*, 13:1117-1129; and Behar, I. (2007) *Expert Opin. Biol. Ther.*, 7:763-779.

Phage Display Libraries

For example, natural or synthetic antibodies are selected by screening phage libraries containing phage that display various fragments of antibody variable region (Fv) fused to phage coat protein. Variable domains can be displayed functionally on phage, either as single-chain Fv (scFv) fragments, in which VH and VL are covalently linked through a short, flexible peptide, or as Fab fragments, in which they are each fused to a constant domain and interact non-covalently, as described in Winter et al., (1994) *Ann. Rev. Immunol.*, 12:433-455. Such phage libraries are panned by affinity chromatography against the desired antigen. Clones expressing Fv fragments capable of binding to the desired antigen are bound to the antigen and thus separated from the non-binding clones in the library. The binding clones are then eluted from the antigen, and can be further enriched by additional cycles of antigen binding/elution. Any antibody can be obtained by designing a suitable antigen screening procedure to select for the phage clone of interest followed by construction of a full length antibody clone using the Fv sequences from the phage clone of interest and suitable constant region (Fc) sequences described in Kabat et al., Sequences of Proteins of Immunological Interest, Fifth Edition, NIH Publication 91-3242, Bethesda Md. (1991), vols. 1-3.

Repertoires of VH and VL genes can be separately cloned by polymerase chain reaction (PCR) and recombined randomly in phage libraries, which can then be searched for antigen-binding clones as described in Winter et al., *Ann. Rev. Immunol.*, 12: 433-455 (1994). Libraries from immunized sources provide high-affinity antibodies to the immunogen without the requirement of constructing hybridomas. Alternatively, the naive repertoire can be cloned to provide a single source of human antibodies to a wide range of non-self and also self antigens without any immunization as described by Griffiths et al., *EMBO J.* 12: 725-734 (1993). Finally, naive libraries can also be made synthetically by cloning the unrearranged V-gene segments from stem cells, and using PCR primers containing random sequence to encode the highly variable CDR3 regions and to accomplish rearrangement in vitro as described by Hoogenboom and Winter, *J. Mol. Biol.*, 227: 381-388 (1992).

VH and VL repertoires are cloned separately, one into a phagemid and the other into a phage vector. The two libraries are then combined by phage infection of phagemid-containing bacteria so that each cell contains a different combination and the library size is limited only by the number of cells present (about $10^{12}$ clones). Both vectors contain in vivo recombination signals so that the VH and VL genes are recombined onto a single replicon and are co-packaged into phage virions. The libraries can provide a large number of diverse antibodies of good affinity ($Kd^{-1}$ of about $10^{-8}$ M).

Filamentous phage is used to display antibody fragments by fusion to a coat protein, for example, the minor coat protein pill. The antibody fragments can be displayed as single chain Fv fragments, in which VH and VL domains are connected on the same polypeptide chain by a flexible polypeptide spacer, e.g. as described by Marks et al., *J. Mol. Biol.*, 222: 581-597 (1991), or as Fab fragments, in which one chain is fused to pill and the other is secreted into the bacterial host cell periplasm where assembly of a Fab-coat protein structure which becomes displayed on the phage surface by displacing some of the wild type coat proteins, e.g. as described in Hoogenboom et al., *Nucl. Acids Res.*, 19: 4133-4137 (1991).

b. Addressable Libraries

Another method of identifying anti-DLL4 antibodies, or fragments thereof, that have a desired specificity and/or activity for a target protein includes addressable combinatorial antibody libraries as described in U.S. Provisional Application Nos. 61/198,764 and 61/211,204, incorporated by reference herein. An advantage of addressable combinatorial libraries compared to display libraries is that each loci represents a different library member whose identity is known by virtue of its address. In such libraries, each individual member of the library is individually generated, and thus the sequence of each member is known. Display of the members of the library can be achieved on any desired format, which permits screening the members not only for binding but also for function. The "Hits" can be quickly identified, including by sequence, coincident with the screening results. Sequencing is not required to obtain structural information about an identified antibody since the sequence of an identified "Hit" is known a priori.

Addressable combinatorial antibody libraries contain antibodies with variable heavy chain and variable light chains composed of recombined human germline segments. Antibody combinatorial diversity in the library exists from recombination of individual V, D and J segments that make up the variable heavy chains and of individual V ($V_\kappa$ or $V_\lambda$) and J ($J_\kappa$ or $J_\lambda$) segments that make up the variable light chains. Additional combinatorial diversity derives from the pairing of different variable heavy chains and variable light chains.

The nucleic acid molecules encoding each VH chain and/or VL chain are individually synthesized, using standard DNA synthesis techniques, in an addressable format, whereby the identity of the nucleic acid sequence of each VH chain and/or VL chain in each locus is known. VH chains and VL chains are then paired, also in an addressable format, such that the identity of each member of the library is known based on its locus or "address". The addressable combinatorial antibody libraries can be screened for binding or activity against a target protein, such as DLL4, to identify antibodies or portions thereof that bind to a target protein and/or modulate an activity of a target protein. By virtue of the fact that these libraries are arrayed, the identity of each individual member in the collection is known during screening, thereby allowing facile comparison of "Hit" and related "non-Hit" antibodies.

Method of Generating a Combinatorial Addressable Antibody Library

U.S. Provisional Appl. Nos. 61/198,764 and 61/211,204, incorporated by reference herein, provide a method of generating a combinatorial antibody library where the identity of every antibody is known at the time of screening by virtue of the combinatorial generation of antibody members. In the combinatorial addressable libraries, variable heavy (VH) and variable light (VL) chain members of the libraries are generated, recombinantly or synthetically by DNA synthesis, from known germline antibody sequences or modified sequences thereof. Antibody combinatorial diversity in the library exists from recombination of individual V, D and J segments that make up the variable heavy chains and of individual V ($V_\kappa$ or $V_\lambda$) and J ($J_\kappa$ or $J_\lambda$) segments that make up the variable light chains. Additional combinatorial diversity derives from the pairing of different variable heavy chains and variable light chains.

Each VL chain of the antibodies in the library is encoded by a nucleic acid molecule that comprises a $V_\kappa$ and a $J_\kappa$ human germline segment or degenerate codons thereof, or a $V_\lambda$ and a $J_\lambda$ human germline segment or degenerate codons thereof, whereby the segments are linked in-frame. The germline segments are joined such that the $V_L$ segment is 5' of the $J_L$ segment. Each VH chain of the antibodies in the library is encoded by a nucleic acid molecule that comprises a $V_H$, $D_H$ and a $J_H$ germline segment, whereby the segments are linked in-frame. The germline segments are joined such that the $V_H$ segment is 5' of the $D_H$ segment, which is 5' of the $J_H$ segment.

The recombination is effected so that each gene segment is in-frame, such that resulting recombined nucleic acid molecules encodes a functional VH or VL polypeptide. For example, recombined segments are joined such that the recombined full length nucleic acid is in frame with the 5' start codon (ATG), thereby allowing expression of a full length polypeptide. Any combination of a V(D)J can be made, and junctions modified accordingly in order to generate a compiled V(D)J sequence that is in-frame, while preserving reading frames of each segment. The choice of junction modification is a function of the combination of V(D)J that will be joined, and the proper reading frame of each gene segment. In some examples, the nucleic acid molecule encoding a VH chain and/or a VL chain are further modified to remove stop codons and/or restriction enzyme sites so that the resulting encoded polypeptide is in-frame and functional.

A nucleic acid that encodes a variable heavy chain or a variable light chain is generated as follows. In the first step, individual germline segments ($V_H$, $D_H$ and $J_H$ for a heavy chain or $V_\kappa$ and a $J_\kappa$, or $V_\lambda$ and $J_\lambda$ for a light chain) are selected for recombination (see e.g. Tables 3-5 herein and the Sequence Listing for exemplary germline segments). The germline segments can be human germline segments, or degenerate sequences thereof, or alternatively the germline segments can be modified. For example, the $D_H$ segment of a variable heavy chain can be translated in any open reading frame, or alternatively, the $D_H$ segment can be the reverse complement of a $D_H$ germline segment. Once selected, the germline segments are joined such that the recombined full length nucleic acid is in frame with the 5' start codon (ATG), thereby allowing expression of a full length polypeptide. Any combination of a V(D)J can be made, and junctions modified accordingly in order to generate a compiled V(D)J sequence that is in-frame, while preserving reading frames of each segment. The V segment is always reading frame 1. The reading frame of the J segment is selected so the correct amino acids are encoded. The D segment can be in any reading frame, but typically, the reading frame is chosen such that the resulting amino acids are predominately hydrophobic. As necessary, nucleic acid modifications are made at the junctions between the gene segments such that each segment is in the desired reading frame. For example, at the V-D junction, one or more nucleotides can be deleted from the 5' end of the D, one or more nucleotides can be deleted from the 3' end of the V or one or more nucleotides can be inserted between the V and D (e.g. a nucleotide can be added to the 3' end of the V). Once the junctions are formed, the sequence is modified to remove any stop codons by substitution of nucleotides, such that stop codon TAA is replaced by codon TAT; stop codon TAG is replaced by codon TAT, and stop codon TGA is replaced by codon TCA. Finally, the nucleic acid can be further modified to, for example, remove unwanted restriction sites, splicing donor or acceptor sites, or other nucleotide sequences potentially detrimental to efficient translation. Modifications of the nucleic acid sequences include replacements or substitutions, insertions, or deletions of nucleotides, or any combination thereof.

The nucleic acid molecules encoding each VH chain and/or VL chain are individually synthesized, using standard DNA synthesis techniques, in an addressable format, whereby the identity of the nucleic acid sequence of each VH chain and/or VL chain in each locus is known.

VH chains and VL chains are then paired, also in an addressable format, such that the identity of each member of the library is known based on its locus or "address". For example, resulting members of the library are produced by co-expression of nucleic acid molecules encoding the recombined variable region genes together, such that when expressed, a combinatorial antibody member is generated minimally containing a VH and VL chain, or portions thereof. In some examples of the methods, the nucleic acid molecule encoding the VH and VL chain can be expressed as a single nucleic acid molecule, whereby the genes encoding the heavy and light chain are joined by a linker. In another example of the methods, the nucleic acid molecules encoding the VH and VL chain can be separately provided for expression together. Thus, upon expression from the recombined nucleic acid molecules, each different member of the library represents a germline encoded antibody, whereby diversity is achieved by combinatorial diversity of V(D)J segments and pairing diversity of heavy and light chains.

A library of antibodies can be generated upon co-expression of a nucleic acid molecule encoding the VH chain and a nucleic acid encoding the VL chain to generate a combinatorial library containing a plurality of different members. The antibodies within the combinatorial addressable germline antibody libraries contain all or a portion of the variable heavy chain (VH) and variable light chain (VL), as long as the resulting antibody is sufficient to form an antigen binding site. Typically, the combinatorial addressable germline antibodies are Fabs. The combinatorial addressable antibody library can be screened to identify a "Hit" antibody against any target antigen, for example, against DLL4.

3. Optimization and Affinity Maturation

Anti-DLL4 antibodies, such as any that are generated or identified by any of the above methods or other methods known to one of skill in the art, can be optimized or improved by engineering or affinity maturation methods. For example, the binding affinity to DLL4 can be optimized or improved. Such methods include, for example, generating and screening antibody libraries using the previously identified antibody as a template by introducing mutations at random in vitro by using error-prone PCR (Zhou et al., *Nucleic Acids Research* (1991) 19(21):6052; and US2004/0110294); randomly mutating one or more CDRs, e.g. using PCR with primers carrying random sequence spanning the CDR of interest, in selected individual Fv clones and screening for higher affinity clones (WO 96/07754); oligonucleotide directed mutagenesis (Rosok et al., *The Journal of Immunology*, (1998) 160: 2353-2359); codon cassette mutagenesis (Kegler-Ebo et al., *Nucleic Acids Research*, (1994) 22(9):1593-1599); degenerate primer PCR, including two-step PCR and overlap PCR (U.S. Pat. Nos. 5,545,142, 6,248,516, and 7,189,841; Higuchi et al., *Nucleic Acids Research* (1988); 16(15):7351-7367; and Dubreuil et al., *The Journal of Biological Chemistry* (2005) 280(26):24880-24887); and recombining the VH or VL domains selected by phage display with repertoires of naturally occurring V domain variants obtained from unimmunized donors and screening for higher affinity in several rounds of chain reshuffling as described in Marks et al., *Biotechnology*, 10: 779-783 (1992).

Affinity maturation methods also include rationale methods of affinity maturation as described in U.S. Provisional Application No. 61/280,618, incorporated by reference herein. For example, the structure-affinity/activity relationship (SAR) of a parent or template antibody can be used to rationally optimize or improve the binding affinity or activity of an antibody. Generally, in the method of affinity maturation, residues to mutagenize in the antibody are identified either by scanning mutagenesis described below or by comparison of the amino acid sequence of the variable heavy or light chain of the antibody with a respective variable heavy or light chain of a related antibody that exhibits reduced activity for the target antigen. This structure-affinity/activity relationship analysis between the antibody and a related antibody or antibodies reveals target regions of the antibody polypeptide that are important for activity. The affinity maturation method provided herein can be performed iteratively to further optimize binding affinity.

For example, SAR can be effected by scanning mutagenesis (e.g. alanine scanning mutagenesis), across the full-length sequence of a variable heavy or light chain or in a region (e.g. CDR) of the variable heavy or light chain. The scanning mutagenesis can reveal each residues contribution to binding to the target antigen. Residues that are essential for activity (e.g. binding), i.e. those whose mutagenesis decreases activity to the target antigen, are not subjected to full or partial saturation mutagenesis. Residues that are not essential for binding, i.e. those whose mutagenesis preserves or increases binding to the target antigen, are subjected to full or partial saturation mutagenesis; mutants are tested for binding to the target antigen to identify mutations that increase binding affinity to the target antigen.

F. Assessing Anti-DLL4 Antibody Properties and Activities

The anti-DLL4 antibodies provided herein can be characterized in binding or other activities using assays well known to one of skill in the art. For example, the anti-DLL4 antibodies can be assayed for the ability to immunospecifically bind to DLL4. The affinity and specificity for DLL4 also can be determined. In addition, in vitro assays and in vivo animal models using the anti-DLL4 antibodies provided herein can be employed for assessing their effects, generally their antagonistic effects for inhibiting the activity of DLL4.

1. Binding

The anti-DLL4 antibodies provided herein can be assessed for their ability to specifically bind DLL4 (e.g. cell-surface expressed DLL4 or an isolated, synthetically generated or recombinantly expressed protein or peptide (e.g. epitope)) and the specifity determined by any method known to one of skill in the art. Exemplary assays are described herein below. Binding assays can be performed in solution, suspension or on a solid support. Negative controls can be included in such assays as a measure of background binding. Binding affinities also can be determined using Scatchard analysis (Munson et al., *Anal. Biochem.*, 107:220 (1980)), surface plasmon resonance, isothermal calorimetry, or other methods known to one of skill in the art.

a. Binding Assays

Generally, binding is detected using a detectable moiety or label (e.g. an enzyme, a radionuclide, a fluorescent probe, electrochemiluminescent label, or a color dye) typically attached to the target or, if desired, directly to the antibody. Alternatively, binding can be detected by a further third reagent that itself is labeled or detectable. For example, detection of an antibody bound to a target protein can be achieved using a labeled capture molecule in a sandwich assay format. Other proteins capable of specifically binding immunoglobulin constant regions, such as protein A or protein G also can be used as the label agent. These proteins exhibit a strong non-immunogenic reactivity with immunoglobulin constant regions from a variety of species (see, e.g., Kronval et al., (1973) *J. Immunol.* 111:1401-1406; Akerstrom et al., (1985) *J. Immunol.* 135:2589-2542). The detection agent can be modified with a detectable moiety, such as biotin, to which another molecule can specifically bind, such as streptavidin. A variety of detectable moieties are well known to those skilled in the art.

The choice of label or detectable group used in the assay is not critical, as long as it does not significantly interfere with the specific binding of the antibody used in the assay. Generally, the choice depends on sensitivity required, ease of conjugation with the compound, stability requirements, available instrumentation, and disposal provisions. One of skill in the art is familiar with labels and can identify a detectable label suitable for and compatible with the assay employed.

The detectable group can be any material having a detectable physical or chemical property. Such detectable labels have been well-developed in the field of immunoassays and, in general, most any label useful in such methods can be applied. Thus, a label is any composition detectable by spectroscopic, photochemical, biochemical, immunochemical, electrical, optical or chemical means. Useful labels include magnetic beads (e.g., DYNABEADS™), fluorescent dyes (e.g., fluorescein isothiocyanate, Texas red, rhodamine, and the like), radiolabels (e.g., $^3$H, $^{125}$I, $^{35}$S, $^{14}$C, or $^{32}$P), enzymes (e.g., horse radish peroxidase, alkaline phosphatase and others commonly used in an ELISA), chemiluminescent labels (luciferin and 2,3-dihydrophtahlazinediones, e.g., luminol), and colorimetric labels such as colloidal gold or colored glass or plastic beads (e.g., polystyrene, polypropylene, latex, etc.). For a review of various labeling or signal producing systems that can be used, see e.g. U.S. Pat. No. 4,391,904.

Means of detecting labels are well known to those of skill in the art. Thus, for example, where the label is a radioactive label, means for detection include a scintillation counter or photographic film as in autoradiography. Where the label is a fluorescent label, it can be detected by exciting the fluorochrome with the appropriate wavelength of light and detecting the resulting fluorescence. The fluorescence can be detected visually, by the use of electronic detectors such as charge coupled devices (CCDs) or photomultipliers and the like. Similarly, enzymatic labels can be detected by providing the appropriate substrates for the enzyme and detecting the resulting reaction product. Finally simple colorimetric labels can be detected simply by observing the color associated with the label.

Some assay formats do not require the use of labeled components. For instance, agglutination assays can be used to detect the presence of the target antibodies. In this case, antigen-coated particles are agglutinated by samples containing the target antibodies. In this format, none of the components need be labeled and the presence of the target antibody is detected by simple visual inspection.

Alternatively, the antibodies provided herein can be screened for their ability to bind to cells, using whole cell panning, with or without subtractive panning. Screening can be done against live cells or against intact, mildly fixed target cells. Methods for whole cell panning have been described previously (see e.g. Siegel et al. (1997) *J. Immunol. Methods* 206:73-85 incorporated herein by reference). Other techniques for screening which can be applied include fluorescent activated cell sorting (FACs). Example 8 exemplifies a binding assay for anti-DLL4 binding to DLL4 expressed on the surface of cells.

For high-throughput screening, assays can be multiplexed. Thus, the binding affinities of antibodies to a number of different target proteins can be determined at once. In one example, different target proteins can be separately labeled with different detectable moieties. For example, different antigens can be coupled to color-coded beads (Schwenk et al. (2007) *Mol. Cell. Prot.,* 6:125-132). In another example, multi-spot plates can be used that permit assay multiplexing by absorption of up to 100 proteins in a locus of the plate (e.g. using Multi-Array or Multi-Spot plates from Meso Scale Discovery; MSD, Gaithersburg, Md.). In such an example, antibodies can be screened by addition of a different antibody to each well of a multi-spot plate. The assay readily permits the screening of thousands of antibodies at once against numerous target proteins. Example 3 exemplifies a binding assay to identify antibodies that bind to DLL4 using a Multispot electrochemiluminescence (ECL) binding assay.

For example, DLL4-expressing cells can be incubated first with an anti-DLL4 antibody followed by a second incubation with a secondary antibody that recognizes the primary antibody and is conjugated with a detectable label such as FITC. After labeling, the cells can be counted with a flow cytometer to analyze the antibody binding. In another example, a DLL4 antigen can be immobilized to a solid support (e.g. a carbon or plastic surface, a tissue culture dish or chip) and contacted with antibody. Unbound antibody or target protein can be washed away and bound complexes can then be detected. Binding assays can be performed under conditions to reduce nonspecific binding, such as by using a high ionic strength buffer (e.g. 0.3-0.4M NaCl) with nonionic detergent (e.g. 0.1% Triton X-100 or Tween 20) and/or blocking proteins (e.g. bovine serum albumin or gelatin).

Other immunoassays also can be used to analyze immunospecific binding and cross-reactivity including, but not limited to, competitive and non-competitive assay systems using techniques such as, but not limited to, western blots, radioimmunoassays, ELISA (enzyme linked immunosorbent assay), Meso Scale Discovery (MSD, Gaithersburg, Md.), "sandwich" immunoassays, immunoprecipitation assays, ELISPOT, precipitin reactions, gel diffusion precipitin reactions, immunodiffusion assays, agglutination assays, complement-fixation assays, immunoradiometric assays, fluorescent immunoassays, protein A immunoassays, immunohistochemistry, or immuno-electron microscopy. Such assays are routine and well known in the art (see, e.g., Ausubel et al, eds, 1994, Current Protocols in Molecular Biology, Vol. 1, John Wiley & Sons, Inc., New York, which is incorporated by reference herein in its entirety). Other assay formats include liposome immunoassays (LIA), which use liposomes designed to bind specific molecules (e.g., antibodies) and release encapsulated reagents or markers. The released chemicals are then detected according to standard techniques (see Monroe et al., (1986) *Amer. Clin. Prod. Rev.* 5:34-41). Exemplary immunoassays not intended by way of limitation are described briefly below.

Immunoprecipitation protocols generally comprise lysing a population of cells in a lysis buffer such as RIPA buffer (1% NP-40 or Triton X-100, 1% sodium deoxycholate, 0.1% SDS, 0.15M NaCl, 0.01M sodium phosphate at pH 7.2, 1% Trasylol) supplemented with protein phosphatase and/or protease inhibitors (e.g., EDTA, PMSF, aprotinin, sodium vanadate), adding the antibody or antigen-binding fragment thereof of interest to the cell lysate, incubating for a period of time (e.g., 1 to 4 hours) at 40° C., adding protein A and/or protein G sepharose beads to the cell lysate, incubating for about an hour or more at 40° C., washing the beads in lysis buffer and resuspending the beads in SDS/sample buffer. The ability of the antibody of interest to immunoprecipitate a particular antigen can be assessed by, e.g., western blot analysis. One of skill in the art is knowledgeable as to the parameters that can be modified to increase the binding of the antibody to an antigen and decrease the background (e.g., pre-clearing the cell lysate with sepharose beads). For further discussion regarding immunoprecipitation protocols see, e.g., Ausubel et al., eds, 1994, Current Protocols in Molecular Biology, Vol. 1, John Wiley & Sons, Inc., New York at 10.16.1.

Western blot analysis generally involves preparing cell extracts, in particular of cells that express DLL4, electrophoresis of the samples in a polyacrylamide gel (e.g., 8%-20% SDS-PAGE depending on the molecular weight of the antigen) or via 2-D gel electrophoresis, transferring the sample from the polyacrylamide gel to a membrane such as nitrocellulose, PVDF or nylon, blocking the membrane in blocking solution (e.g., PBS with 3% BSA or non-fat milk), washing the membrane in washing buffer (e.g., PBS-Tween 20), probing the membrane with primary antibody (i.e. the antibody of interest) diluted in blocking buffer, washing the membrane in washing buffer, probing the membrane with a secondary antibody (which recognizes the primary antibody, e.g., an anti-human antibody) conjugated to an enzymatic substrate (e.g., horseradish peroxidase or alkaline phosphatase) or radioactive molecule (e.g., $^{32}P$ or $^{125}I$) diluted in blocking buffer, washing the membrane in wash buffer, and detecting the presence of the antigen. One of skill in the art is knowledgeable as to the parameters that can be modified to increase the signal detected and to reduce the background noise. For further discussion regarding western blot protocols see, e.g., Ausubel et al, eds, 1994, Current Protocols in Molecular Biology, Vol. 1, John Wiley & Sons, Inc., New York at 10.8.1.

ELISAs also can be used to assess binding. ELISAs generally involve preparing antigen (generally a recombinant or synthetic protein or peptide thereof, such as containing an epitope), coating the well of a 96 well microtiter plate with the antigen, adding the antibody of interest conjugated to a detectable compound such as an enzymatic substrate (e.g., horseradish peroxidase or alkaline phosphatase) to the well and incubating for a period of time, and detecting the presence of the antigen. In ELISAs, the antibody of interest does not have to be conjugated to a detectable compound; instead, a second antibody (which recognizes the antibody of interest) conjugated to a detectable compound can be added to the well. Further, instead of coating the well with the antigen, the antibody can be coated to the well. In this case, a second antibody conjugated to a detectable compound can be added following the addition of the antigen of interest to the coated well. One of skill in the art is knowledgeable as to the parameters that can be modified to increase the signal detected as well as other variations of ELISAs known in the art. For further discussion regarding ELISAs see, e.g., Ausubel et al, eds, 1994, Current Protocols in Molecular Biology, Vol. 1, John Wiley & Sons, Inc., New York at 11.2.1. Example 7 exemplifies an ELISA binding assay to assess the dose-dependent binding of anti-DLL4 antibodies to DLL4.

Immunohistochemistry can be used. Immunohistochemistry involves preparing a tissue sample (e.g. from a DLL4-expressing cell), fixing the tissue to preserve protein molecules in their native conformation, bathing the sample in a permeabilization reagent (e.g. Tween, Nonidet P40) to penetrate the tissue, blocking the sample with blocking solution (e.g., PBS with 3% BSA or non-fat milk), washing the sample in washing buffer (e.g., PBS-Tween 20), probing the sample with primary antibody (i.e. the antibody of interest) diluted in blocking buffer, washing the sample in washing buffer, probing the sample with a secondary antibody (which recognizes the primary antibody, e.g., an anti-human antibody) conjugated to a fluorescent dye (e.g. fluoresein isothiocynate, alexa fluor, rhodamine) diluted in blocking buffer, washing the sample in wash buffer, and detecting the presence of the antigen via fluorescent microscopy. One of skill in the art is knowledgeable as to the parameters that can be modified to increase the signal detected and to reduce the background noise.

In any of the above binding assays, competition experiments can be performed. For example, anti-DLL4 antibodies can be assessed for their ability to block binding of Notch receptors to DLL4. Thus, assays also include binding assays to assess the inhibition of DLL4-Notch interaction in the presence of an anti-DLL4 antibody. Such assays can be used to identify angonist antibodies. This is exemplified in Example 10 and Example 11.

b. Binding Affinity

The binding affinity of an antibody to an antigen can be determined. Any method known to one of skill in the art can be used to measure the binding affinity of an antibody. For example, the binding properties of an antibody can be assessed by performing a saturation binding assay, for example, a saturation ELISA, whereby binding to a target protein is assessed with increasing amounts of antibody. In such experiments, it is possible to assess whether the binding is dose-dependent and/or saturable. In addition, the binding affinity can be extrapolated from the 50% binding signal. Typically, apparent binding affinity is measured in terms of its association constant (Ka) or dissociation constant (Kd) and determined using Scatchard analysis (Munson et al., *Anal. Biochem.*, 107:220 (1980).

For example, binding affinity to a target protein can be assessed in a competition binding assay in where increasing concentrations of unlabeled protein is added, such as by radioimmunoassay (RIA) or ELISA. Binding affinity also can be analyzed surface plasmon resonance, e.g. using BIAcore kinetic analysis. This involves analyzing the binding and dissociation of an antibody member from chips containing immobilized target proteins on their surface. The Biacore evaluation software generates the values of Ka and Kd by fitting the data to interaction models.

It is understood that the binding affinity of an antibody can vary depending on the assay and conditions employed, although all assays for binding affinity provide a rough approximation. By performing various assays under various conditions it is possible to estimate the binding affinity of an antibody. In addition, binding affinities can differ depending on the target source, whether as a cell-expressed target antigen or as a recombinant or synthetically produced antigen. Thus, the binding affinity of an anti-DLL4 antibody for DLL4 expressed on the surface of a cells can differ from the binding affinity determined using an isolated or purified DLL4 protein. Further, binding affinities can differ depending on the structure of an antibody. For example, generally a bivalent antibody, for example a bivalent F(ab')$_2$ fragment or full-length IgG, has a better binding affinity then a monovalent Fab antibody. Hence, it is understood that where a Fab has a specified binding affinity for a particular target, it is excepted that the binding affinity is even greater for a full-length IgG that is bivalent.

Example 6 exemplifies assessing binding affinity using surface plasmon resonance.

2. Functional Activity

Anti-DLL4 antibodies provided herein can be screened for modulation of an functional activity of DLL4 using in vitro or in vivo assays known to one of skill in the art. Assays for functional activity include those that assess activation of Notch signaling by DLL4 by assaying for signal transduction and/or down stream functional activities such as are described above. Activation of Notch can be achieved, for example, by coincubation with cells that express DLL4 and/or immobilization of DLL4, and assays performed in the presence of antibody members. In such assays, for example, the effects of antibodies on endothelial cell proliferation (e.g. HUVECs) induced by DLL4 can be assessed (see e.g., Ridgway et al. (2006) Nature, 444:1083). In some examples, antibodies can be used to assess effects on cell differentiation of a cell expressing Notch. The cells can be co-cultured with cells expressing a ligand for Notch, for example, DLL4 or Jag1. To identify antibodies that promote differentiation (i.e. interfere with Notch activation), antibodies can be added to the assay.

For cell-based assays, assays are generally performed using cell lines that are known to express the target of interest (Notch or a Notch ligand, e.g. DLL4). Such cells are known to one of skill in the art. For example, one can consult the ATCC Catalog (atcc.org) to identify cell lines. Also, if a particular cell type is desired, the means for obtaining such cells, and/or their instantly available source is known to those in the art. An analysis of the scientific literature can readily reveal appropriate choice of cells expressing any desired target. In addition, cells lines expressing a target of interest can be generated by transient or stable transfection with an expression vector expressing a target of interest. Methods of transfection and expression are known to those of skill in the art (see e.g., Kaufman R. J. (1990) *Methods in Enzymology* 185:537-566). In addition, any primary cell or cell line can be assessed for expression of a particular target (e.g. cell surface marker). Cell surface markers can be assayed using fluorescently labeled antibodies and FACS. Suitable cell lines include A549 (lung), HeLa, Jurkat, BJAB, Colo205, H1299, MCF7, MDA-MB-231, PC3, HUMEC, HUVEC, and PrEC. Exemplary assays to assess the effects of modulation of anti-DLL4 antibodies on a functional activity are set forth in Example 13 and Example 14.

Other assays that can be used to assess anti-DLL4 antibodies include any assay that models angiogenesis. For example, a human umbilical vein endothelial cells (HUVECs) can be grown in fibrin gels in the presence of co-cultured human skin fibroblast (SF) cells to generate sprouts (see e.g. published U.S. Application No. 20080175847; see also Nakatsu et al. *Microvasc. Res.* 66:102-12 (2003)). In such an assay, Cytodex™ 3 beads (Amersham Phamacia Biotech) are coated with HUVEC cells. HUVEC-coated beads are imbedded in a fibrin clot in one well of a 12-well culture plate. SF cells (e.g. $8\times10^4$) are plated on top of the clot. Anti-DLL4 antibodies can be added. After a designated time (e.g. between days 7 and 9) the assay can be terminated and the length and number of sprouts can be assessed by immunostaining and/or imaging, for example, using an anti-CD31 antibody (clone EM59; eBioscience).

Anti-DLL4 antibodies provided herein that contain a modification in the Fc region also can be assessed to determine effector functions of the antibody. For example, the Fc activities of the produced antibody are measured to ensure that only the desired properties are maintained. In vitro and/or in vivo cytotoxicity assays can be conducted to confirm the reduction/depletion of CDC and/or ADCC activities. For example, Fc receptor (FcR) binding assays can be conducted to ensure that the antibody lacks FcγR bomdomg (hence likely lacking ADCC activity), but retains FcRn binding ability. The primary cells for mediating ADCC, NK cells, express FcγRIII only, whereas monocytes express FcγRI, FcγRII and FcγRIII. FcR expression on hematopoietic cells is summarized in Table 3 on page 464 of Ravetch and Kinet, *Annu. Rev. Immunol.*, 9:457-92 (1991). An example of an in vitro assay to assess ADCC activity of a molecule of interest is described in U.S. Pat. Nos. 5,500,362 or 5,821,337. Useful effector cells for such assays include peripheral blood mononuclear cells (PBMC) and Natural Killer (NK) cells. Alternatively, or additionally, ADCC activity of the molecule of interest can be assessed in vivo, e.g., in an animal model such as that disclosed in Clynes et al. *Proc. Natl. Acad. Sci. USA* 95:652-656 (1998). C1q binding assays can also be carried out to confirm that the antibody is unable to bind C1q and hence lacks CDC activity. To assess complement activation, a CDC assay, e.g. as described in Gazzano-Santoro et al. *J. Immunol. Methods* 202:163 (1996) can be performed. FcRn binding and in vivo clearance/half-life determinations can also be performed using method known in the art.

3. Animal Models

Anti-DLL4 antibodies, for example any provided herein, can be assessed in vivo assays associated with aberrant activity of DLL4 or its receptor Notch. In general, the method involves administering an antibody to a subject, generally a non-human animal model for a disease or condition and determining the effect of the antibody on the on the disease or condition of the model animal. In vivo assays include controls, where suitable controls include a sample in the absence of the antibody.

Generally, assays in animals include those that assess the effects of antibodies on angiogenesis or tumor growth. Exemplary of such assays are described in published U.S. Application No. 20090035308 and 2008 0175847. In one example, in vivo angiogenesis can by assayed using a matrigel plug assay. For example, a matrigel plug can be injected into the ventral abdominal subcutaneous tissue of mice, in the presence or absence of anti-DLL4 antibodies and/or VEGF. After a designated time, e.g. six days, the matrigel plug can be recovered, weighed, and assessed for hemoglobin measurement and immunohistochemical analysis. For example, vascular identity of infiltrating cells can be established with PECAM immunostaining. In such examples, the VEGF samples contain recruited endothelial cells and various stages of vascular structures formed throughout the plug. Vascularization can be assessed in the presence and absence of anti-DLL4 antibodies.

In another example, a tumor xenograft model can be used to assess the activity of anti-DLL4 antibodies on tumor growth. For example, tumor cells such as HT29 (human colon carcinoma cell line) and KS-SLK (human Kaposi's sarcoma cell line) cells can implanted into mice subcutaneously. If study of local effects is desired, cells can be premixed with matrigel and implanted subcutaneously. The antibody can be administered before or coincident with establishment of the tumor, or after tumor establishment. The antibodies also can be administered in combination with anti-VEGF or other combination treatment. In some examples, antibody is administered days to weeks after establishment of the tumor. In other examples, for study of local effects, cells can be premixed with matrigel-containing vehicle control or anti-DLL4 antibody. The size of the tumors can be monitored over hours, days and weeks by sacrificing the animal and isolating the tumor. The blood vessel density, branching of the tumors and tumor vascular perfusion also can be assessed and compared to tumors from mice injected with control. A tumor xenograft model also can be induced using MDA-MB-435, HM7, Colo205 or Calu6 cells (see e.g. U.S. published application No. US20080175847). In addition, pre-clinical tumor models also can be used, including but not limited to, MV-522, WEHI3, SK-OV-3X1, LL2, EL4, H11299, SKMES-1, MX-1, SW620, and LS174T xenograft tumor models (see e.g. U.S. published application No. US20080175847).

In a further example, endothelial cell proliferation and arterial development in the vasculature in vivo can be assessed, for example in the vasculature of the retina. In such an example, anti-DLL4 antibody or control can be injected intraperitoneally into mice. Eyes can be collected at various time points and fixed with 4% paraformaldehyde. Retinas can be dissected and incubated with various antibodies. For example, proliferation can be assessed by labeling with Ki67 (e.g. clone Sp6; Lab Vision) in the presence or absence of anti-DLL4 antibody. Also, anti-α smooth muscle actin (ASMA; Sigma-Aldrich) staining, which is associated with the retinal artieries, can be used to assess the morphology of arteries. Generally, a hyperproliferation phenotype of retinal endothelial cells in observed by blockade of DLL4. Further, disruption of radially alternating arteries and veins also is observed.

G. Methods of Production of Antibodies

Antibodies provided herein can be expressed in host cells and produced therefrom. The antibodies can be expressed as full-length, or as antibodies that are less then full length, for example, as antibody fragments. Nucleic acid molecules and antibodies provided herein can be made by any method known to one of skill in the art. Such procedures are routine and are well known to the skill artisan. They include routine molecular biology techniques including gene synthesis, PCR, ligation, cloning, transfection and purification techniques. A description of such procedures is provided below.

For example, nucleic acid sequences can be constructed using gene synthesis techniques. Gene synthesis or routine molecular biology techniques also can be used to effect insertion, deletion, addition or replacement of nucleotides. For example, additional nucleotide sequences can be joined to a nucleic acid sequence. In one example linker sequences can be added, such as sequences containing restriction endonuclease sites for the purpose of cloning the synthetic gene into a vector, for example, a protein expression vector or a vector designed for the amplification of the antibody constant region coding DNA sequences. Furthermore, additional nucleotide sequences specifying functional DNA elements can be operatively linked to a recombined germline encoding nucleic acid molecule. Examples of such sequences include, but are not limited to, promoter sequences designed to facilitate intracellular protein expression, and leader peptide sequences designed to facilitate protein secretion. Additional nucleotide sequences such as sequences specifying protein binding regions also can be linked to nucleic acid sequences. Such regions include, but are not limited to, sequences to facilitate uptake of recombined antibodies or fragments thereof into specific target cells, or otherwise enhance the pharmacokinetics of the synthetic gene.

The nucleic acids encoding antibody polypeptides are typically cloned into a vector before transformation into prokaryotic or eukaryotic cells. Choice of vector can depend on the desired application. For example, after insertion of the nucleic acid, the vectors typically are used to transform host cells, for example, to amplify the antibody genes for replication and/or expression thereof. In such examples, a vector suitable for high level expression is used.

Generally, nucleic acid encoding the heavy chain of an antibody is cloned into a vector and the nucleic acid encoding the light chain of an antibody is cloned into the vector. The genes can be cloned into a single vector for dual expression thereof, or into separate vectors. If desired, the vectors also can contain further sequences encoding additional constant region(s) or hinge regions to generate other antibody forms.

In one example, nucleic acid encoding the heavy chain of an antibody, is ligated into a first expression vector and nucleic acid encoding the light chain of an antibody, is ligated into a second expression vector. The expression vectors can be the same or different, although generally they are sufficiently compatible to allow comparable expression of proteins (heavy and light chain) therefrom. The first and second expression vectors are generally co-transfected into host cells, typically at a 1:1 ratio. Exemplary of vectors include, but are not limited to, pγ1HC and pκLC (Tiller et al. (2008) *J Immunol. Methods,* 329:112-24). Other expression vectors include the light chain expression vector pAG4622 and the heavy chain expression vector pAH4604 (Coloma et al. (1992) *J Immunol. Methods,* 152:89-104). The pAG4622 vector contains the genomic sequence encoding the C-region domain of the human κL chain and the gpt selectable marker. The pAH4604 vectors contains the hisD selectable marker and sequences encoding the human H chain γ1 C-region domain. In another example, the heavy and light chain can be cloned into a single vector that has expression cassettes for both the heavy and light chain. Other exemplary expression vectors include Plasmids A, C, D and E, described elsewhere herein.

Expression can be in any cell expression system known to one of skill in the art. Exemplary cells for expression include, but are not limited to, 293FS cells, HEK293-6E cells or CHO cells. Other expression vectors and host cells are described below.

Hence, antibodies provided herein can be generated or expressed as full-length antibodies or as antibodies that are less than full length, including, but not limited to Fabs, Fab hinge fragment, scFv fragment, scFv tandem fragment and scFv hinge and scFv hinge(ΔE) fragments. Various techniques have been developed for the production of antibody fragments. Traditionally, these fragments were derived via proteolytic digestion of intact antibodies (see e.g. Morimoto et al. (1992) *Journal of Biochemical and Biophysical Methods,* 24:107-117; Brennance et al. (1985) *Science,* 229:81). Fragments also can be produced directly by recombinant host cells. Fab, Fv and scFv antibody fragments can all be expressed in and secreted from host cells, such as *E. coli*, thus allowing the facile production of large amounts of these fragments. Also, Fab'-SH fragments can be chemically coupled to form F(ab')$_2$ fragments (Carter et al. (1992) *Bio/Technology,* 10:163-167). According to another approach, F(ab')$_2$ fragments can be isolated directly from recombinant host cell culture. In other examples, the antibody of choice is a single chain Fv fragment (scFv) (see e.g. WO93/16185; U.S. Pat. Nos. 5,571,894 and 5,587,458. Fv and sFv are the only species with intact combining sites that are devoid of constant regions; thus, they are suitable for reduced nonspecific binding during in vivo use. sFv fusion proteins can be constructed to yield fusion of an effector protein at either the amino or the carboxy terminius of an sFv. The antibody fragment can also be a linear antibody (see e.g. U.S. Pat. No. 5,641,870). Such linear antibody fragments can be monospecific or bispecific. Other techniques for the production of antibody fragments are known to one of skill in the art.

For example, upon expression, antibody heavy and light chains pair by disulfide bond to form a full-length antibody or fragments thereof. For example, for expression of a full-length Ig, sequences encoding the $V_H$-$C_H$1-hinge-$C_H$2-$C_H$3 can be cloned into a first expression vector and sequences encoding the $V_L$-$C_L$ domains can be cloned into a second expression vector. Upon co-expression with the second expression vector encoding the $V_L$-$C_L$ domains, a full-length antibody is expressed. In another example, to generate a Fab, sequences encoding the $V_H$-$C_H$1 can be cloned into a first expression vector and sequences encoding the $V_L$-$C_L$ domains can be cloned into a second expression vector. The heavy chain pairs with a light chain and a Fab monomer is generated. In this example, exemplary vectors include Plasmids A, C, D and E as described elsewhere herein. Sequences of $C_H$1, hinge, $C_H$2 and/or $C_H$3 of various IgG sub-types are known to one of skill in the art (see e.g. U.S. Published Application No. 20080248028; see also SEQ ID NO: 891). Similarly, sequences of CL, lambda or kappa, also is known (see e.g. U.S. Published Application No. 20080248028; see also SEQ ID NOS: 892-893).

1. Vectors

Provided herein are vectors that contain nucleic acid encoding the recombined antibodies or portions thereof. The nucleic acids encoding antibody polypeptides are typically cloned into a intermediate vector before transformation into prokaryotic or eukaryotic cells. Choice of vector can depend on the desired application. For example, after insertion of the nucleic acid, the vectors typically are used to transform host cells, for example, to amplify the recombined antibody genes for replication and/or expression thereof. In such examples, a vector suitable for high level expression is used. In other cases, a vector is chosen that is compatible with display of the expressed polypeptide on the surface of the cell.

Many expression vectors are available and known to those of skill in the art for the expression of recombined antibodies or portions thereof. The choice of an expression vector is influenced by the choice of host expression system. Such selection is well within the level of skill of the skilled artisan. In general, expression vectors can include transcriptional promoters and optionally enhancers, translational signals, and transcriptional and translational termination signals. Expression vectors that are used for stable transformation typically have a selectable marker which allows selection and maintenance of the transformed cells. In some cases, an origin of replication can be used to amplify the copy number of the vectors in the cells. Vectors also generally can contain additional nucleotide sequences operably linked to the ligated nucleic acid molecule (e.g. His tag, Flag tag). For purposes herein, vectors generally include sequences encoding the constant region. Thus, recombined antibodies or portions thereof also can be expressed as protein fusions. For example, a fusion can be generated to add additional functionality to a polypeptide. Examples of fusion proteins include, but are not limited to, fusions of a signal sequence, an epitope tag such as for localization, e.g. a his$_6$ tag (SEQ ID NO: 906) or a myc tag, or a tag for purification, for example, a GST fusion, and a sequence for directing protein secretion and/or membrane association.

For example, expression of the proteins can be controlled by any promoter/enhancer known in the art. Suitable bacterial promoters are well known in the art and described herein below. Other suitable promoters for mammalian cells, yeast cells and insect cells are well known in the art and some are exemplified below. Selection of the promoter used to direct expression of a heterologous nucleic acid depends on the particular application. Promoters which can be used include but are not limited to eukaryotic expression vectors containing the SV40 early promoter (Bernoist and Chambon, *Nature* 290:304-310 (1981)), the promoter contained in the 3' long terminal repeat of Rous sarcoma virus (Yamamoto et al. *Cell* 22:787-797 (1980)), the herpes thymidine kinase promoter (Wagner et al., *Proc. Natl. Acad. Sci. USA* 78:1441-1445 (1981)), the regulatory sequences of the metallothionein gene (Brinster et al., *Nature* 296:39-42 (1982)); prokaryotic expression vectors such as the b-lactamase promoter (Jay et al., (1981) *Proc. Natl. Acad. Sci. USA* 78:5543) or the tac promoter (DeBoer et al., *Proc. Natl. Acad. Sci. USA* 80:21-25 (1983)); see also "Useful Proteins from Recombinant Bacteria": in Scientific American 242:79-94 (1980)); plant expression vectors containing the nopaline synthetase promoter (Herrara-Estrella et al., *Nature* 303:209-213 (1984)) or the cauliflower mosaic virus 35S RNA promoter (Gardner et al., *Nucleic Acids Res.* 9:2871 (1981)), and the promoter of the photosynthetic enzyme ribulose bisphosphate carboxylase (Herrera-Estrella et al., *Nature* 310:115-120 (1984)); promoter elements from yeast and other fungi such as the Gal4 promoter, the alcohol dehydrogenase promoter, the phosphoglycerol kinase promoter, the alkaline phosphatase promoter, and the following animal transcriptional control regions that exhibit tissue specificity and have been used in transgenic animals: elastase I gene control region which is active in pancreatic acinar cells (Swift et al., *Cell* 38:639-646 (1984); Ornitz et al., *Cold Spring Harbor Symp. Quant. Biol.* 50:399-409 (1986); MacDonald, *Hepatology* 7:425-515 (1987)); insulin gene control region which is active in pancreatic beta cells (Hanahan et al., *Nature* 315:115-122 (1985)), immunoglobulin gene control region which is active in lymphoid cells (Grosschedl et al., *Cell* 38:647-658 (1984); Adams et al., *Nature* 318:533-538 (1985); Alexander et al., *Mol. Cell Biol.* 7:1436-1444 (1987)), mouse mammary tumor virus control region which is active in testicular, breast, lymphoid and mast cells (Leder et al., *Cell* 45:485-495 (1986)), albumin gene control region which is active in liver (Pinckert et al., *Genes and Devel.* 1:268-276 (1987)), alpha-fetoprotein gene control region which is active in liver (Krumlauf et al., *Mol. Cell. Biol.* 5:1639-1648 (1985); Hammer et al., *Science* 235:53-58 1987)), alpha-1 antitrypsin gene control region which is active in liver (Kelsey et al., *Genes and Devel* 1:161-171 (1987)), beta globin gene control region which is active in myeloid cells (Magram et al., *Nature* 315:338-340 (1985); Kollias et al., *Cell* 46:89-94 (1986)), myelin basic protein gene control region which is active in oligodendrocyte cells of the brain (Readhead et al., *Cell* 48:703-712 (1987)), myosin light chain-2 gene control region which is active in skeletal muscle (Shani, *Nature* 314:283-286 (1985)), and gonadotrophic releasing hormone gene control region which is active in gonadotrophs of the hypothalamus (Mason et al., *Science* 234:1372-1378 (1986)).

In addition to the promoter, the expression vector typically contains a transcription unit or expression cassette that contains all the additional elements required for the expression of the antibody, or portion thereof, in host cells. A typical expression cassette contains a promoter operably linked to the nucleic acid sequence encoding the germline antibody chain and signals required for efficient polyadenylation of the transcript, ribosome binding sites and translation termination. Additional elements of the cassette can include enhancers. In addition, the cassette typically contains a transcription termination region downstream of the structural gene to provide for efficient termination. The termination region can be obtained from the same gene as the promoter sequence or can be obtained from different genes.

Some expression systems have markers that provide gene amplification such as thymidine kinase and dihydrofolate reductase. Alternatively, high yield expression systems not involving gene amplification are also suitable, such as using a baculovirus vector in insect cells, with a nucleic acid sequence encoding a germline antibody chain under the direction of the polyhedron promoter or other strong baculovirus promoter.

For purposes herein, vectors are provided that contain a sequence of nucleotides that encodes a constant region of an antibody operably linked to the nucleic acid sequence encoding the recombined variable region of the antibody. The vector can include the sequence for one or all of a CH1, CH2, hinge, CH3 or CH4 and/or CL. Generally, such as for expression of Fabs, the vector contains the sequence for a CH1 (amino acids 1-103 of SEQ ID NO:891) or CL (for kappa light chains, see SEQ ID NO:892; for lambda light chains, see SEQ ID NO:893). The sequences of constant regions or hinge regions are known to one of skill in the art (see e.g. U.S. Published Application No. 20080248028 and SEQ ID NOS: 891-893, including CH1 (amino acids 1-103 of SEQ ID NO:891), IgG1 hinge region (amino acids 104-119 of SEQ ID NO:891), IgG1 CH2 (amino acids 120-223 of SEQ ID NO:891), IgG1 CH3 (amino acids 224-330 of SEQ ID NO:891), CL kappa (SEQ ID NO:892) and CL lambda (SEQ ID NO:893). Exemplary of such vectors containing a heavy chain constant region gene (e.g. CH1) are plasmids A and D, described herein. Exemplary of such vectors containing a light chain constant region genes are plasmids C and E, described herein.

Exemplary expression vectors include any mammalian expression vector such as, for example, pCMV. For bacterial expression, such vectors include pBR322, pUC, pSKF, pET23D, and fusion vectors such as MBP, GST and LacZ. Exemplary of such a vector are bacterial expression vectors such as, for example, plasmid A, plasmid C, plasmid D and plasmid E, described herein. Other eukaryotic vectors, for example any containing regulatory elements from eukaryotic viruses can be used as eukaryotic expression vectors. These include, for example, SV40 vectors, papilloma virus vectors, and vectors derived from Epstein-Bar virus. Other exemplary eukaryotic vectors include pMSG, pAV009/A+, pMT010/A+, pMAMneo-5, baculovirus pDSCE, and any other vector allowing expression of proteins under the direction of the CMV promoter, SV40 early promoter, SV40 late promoter, metallothionein promoter, murine mammary tumor virus promoter, Rous sarcoma virus promoter, polyhedron promoter, or other promoters shown effective for expression in eukaryotes.

Exemplary plasmid vectors for transformation of E. coli cells, include, for example, the ColE1 replication vectors described herein. Several features common to all these vectors include (a) a pBAD inducible promoter; (b) an AraC gene, which controls the pBAD promoter; (c) a synthetic ribosomal binding site (RBS) for efficient translation; (d) a ColE1 origin of replication, allowing for high copy expression; (e) a STII leader sequence, allowing for expressed proteins to be translocated to the periplasm; (f) a f1 origin of replication; and (g) a gene for conferring antibiotic resistance. Such plasmids include plasmid A (SEQ ID NO:84), plasmid C (SEQ ID NO:86), plasmid D (SEQ ID NO:85) and plasmid E (SEQ ID NO:87). Plasmid A and Plasmid D are utilized for expression of heavy chain antibody genes in as they contain a gene for the heavy chain constant region (CH1) operably linked to the inserted gene for the heavy chain variable region.

The vectors contain NheI and NcoI restriction sites to allow for cloning of the recombined antibody genes described herein. Both vectors contain a pUC origin of replication, a ColE1 type origin of replication, and an aminoglycoside phosphotransferase gene conferring kanamycin resistance. Plasmid A contains a $(His)_6$ Tag (SEQ ID NO: 906), and a Flag Tag for protein purification. Plasmid D contains both a $(His)_6$ Tag (SEQ ID NO: 906), and a Flag Tag, and an additional LPETG tag, which allows for covalent attachment of the resulting protein using a sortase. Plasmid C and Plasmid E are utilized for expression of light chain antibody genes in as they contain a gene for the light chain constant region (CL) operably linked to the inserted gene for the light chain variable region. Plasmid C is specific for kappa light chains and contains BseWI and NcoI restriction sites to allow for cloning of the recombined antibody genes described herein. Plasmid E is specific for lambda light chains and contains AcrII and NcoI restriction sites to allow for cloning of the recombined antibody genes described herein. Both vectors contain a 3.3 origin of replication, a ColE1 type origin of replication, and a gene conferring chloramphenicol resistance. The vectors described above are designed to be utilized in a dual vector system, in which a light chain vector and a heavy chain vector are co-transformed. Thus, they contain two different but compatible ColE1 origins of replication utilized, one for heavy chains and one light chain. This allows for efficient expression of both chains of the antibody when the vectors are co-transformed and expressed.

Any methods known to those of skill in the art for the insertion of DNA fragments into a vector can be used to construct expression vectors containing a nucleic acid encoding an antibody chain. These methods can include in vitro recombinant DNA and synthetic techniques and in vivo recombinants (genetic recombination). The insertion into a cloning vector can, for example, be accomplished by ligating the DNA fragment into a cloning vector which has complementary cohesive termini. If the complementary restriction sites used to fragment the DNA are not present in the cloning vector, the ends of the DNA molecules can be enzymatically modified. Alternatively, any site desired can be produced by ligating nucleotide sequences (linkers) onto the DNA termini; these ligated linkers can contain specific chemically synthesized nucleic acids encoding restriction endonuclease recognition sequences.

2. Cells and Expression Systems

Cells containing the vectors also are provided. Generally, any cell type that can be engineered to express heterologous DNA and has a secretory pathway is suitable. Expression hosts include prokaryotic and eukaryotic organisms such as bacterial cells (e.g. *E. coli*), yeast cells, fungal cells, Archea, plant cells, insect cells and animal cells including human cells. Expression hosts can differ in their protein production levels as well as the types of post-translational modifications that are present on the expressed proteins. Further, the choice of expression host is often related to the choice of vector and transcription and translation elements used. For example, the choice of expression host is often, but not always, dependent on the choice of precursor sequence utilized. For example, many heterologous signal sequences can only be expressed in a host cell of the same species (i.e., an insect cell signal sequence is optimally expressed in an insect cell). In contrast, other signal sequences can be used in heterologous hosts such as, for example, the human serum albumin (hHSA) signal sequence which works well in yeast, insect, or mammalian host cells and the tissue plasminogen activator pre/pro sequence which has been demonstrated to be functional in insect and mammalian cells (Tan et al., (2002) *Protein Eng.*

15:337). The choice of expression host can be made based on these and other factors, such as regulatory and safety considerations, production costs and the need and methods for purification. Thus, the vector system must be compatible with the host cell used.

Expression in eukaryotic hosts can include expression in yeasts such as *Saccharomyces cerevisiae* and *Pichia pastoris*, insect cells such as *Drosophila* cells and *lepidopteran* cells, plants and plant cells such as tobacco, corn, rice, algae, and lemna. Eukaryotic cells for expression also include mammalian cells lines such as Chinese hamster ovary (CHO) cells or baby hamster kidney (BHK) cells. Eukaryotic expression hosts also include production in transgenic animals, for example, including production in serum, milk and eggs.

Recombinant molecules can be introduced into host cells via, for example, transformation, transfection, infection, electroporation and sonoporation, so that many copies of the gene sequence are generated. Generally, standard transfection methods are used to produce bacterial, mammalian, yeast, or insect cell lines that express large quantity of antibody chains, which is then purified using standard techniques (see e.g., Colley et al. (1989) *J. Biol. Chem.*, 264:17619-17622; Guide to Protein Purification, in Methods in Enzymology, vol. 182 (Deutscher, ed.), 1990). Transformation of eukaryotic and prokaryotic cells are performed according to standard techniques (see, e.g., Morrison (1977) *J. Bact.* 132: 349-351; Clark-Curtiss and Curtiss (1983) *Methods in Enzymology*, 101, 347-362). For example, any of the well-known procedures for introducing foreign nucleotide sequences into host cells can be used. These include the use of calcium phosphate transfection, polybrene, protoplast fusion, electroporation, biolistics, liposomes, microinjection, plasma vectors, viral vectors and any other the other well known methods for introducing cloned genomic DNA, cDNA, synthetic DNA or other foreign genetic material into a host cell. Generally, for purposes herein, host cells are transfected with a first vector encoding at least a VH chain and a second vector encoding at least a VL chain. Thus, it is only necessary that the particular genetic engineering procedure used be capable of successfully introducing at least both genes into the host cell capable of expressing germline, or modified form thereof, antibody polypeptide.

Transformation of host cells with recombinant DNA molecules that incorporate the isolated recombined variable region gene, cDNA, or synthesized DNA sequence enables generation of multiple copies of the gene. Thus, the gene can be obtained in large quantities by growing transformants, isolating the recombinant DNA molecules from the transformants and, when necessary, retrieving the inserted gene from the isolated recombinant DNA. Generally, After the expression vector is introduced into the cells, the transfected cells are cultured under conditions favoring expression of the germline chain, which is recovered from the culture using standard purification techniques identified below.

Antibodies and portions thereof can be produced using a high throughput approach by any methods known in the art for protein production including in vitro and in vivo methods such as, for example, the introduction of nucleic acid molecules encoding recombined antibodies or portions thereof into a host cell or host animal and expression from nucleic acid molecules encoding recombined antibodies in vitro. Prokaryotes, especially *E. coli*, provide a system for producing large amounts of recombined antibodies or portions thereof, and are particularly desired in applications of high-throughput expression and purification of proteins. Transformation of *E. coli* is a simple and rapid technique well known to those of skill in the art. *E. coli* host strains for high through-put expression include, but are not limited to, BL21 (EMD Biosciences) and LMG194 (ATCC). Exemplary of such an *E. coli* host strain is BL21. Vectors for high throughput expression include, but are not limited to, pBR322 and pUC vectors. Exemplary of such vectors are the vectors described herein, including plasmid A, plasmid C, plasmid D and plasmid E. Automation of expression and purification can facilitate high-throughput expression. For example, use of a Piccolo™ system, a fully automatic system that combines cell culture with automated harvesting, lysing and purification units, or other similar robotic system can be employed.

a. Prokaryotic Expression

Prokaryotes, especially *E. coli*, provide a system for producing large amounts of recombined antibodies or portions thereof. Transformation of *E. coli* is a simple and rapid technique well known to those of skill in the art. Expression vectors for *E. coli* can contain inducible promoters that are useful for inducing high levels of protein expression and for expressing proteins that exhibit some toxicity to the host cells. Examples of inducible promoters include the lac promoter, the trp promoter, the hybrid tac promoter, the T7 and SP6 RNA promoters and the temperature regulated $\lambda P_L$ promoter.

Recombined antibodies or portions thereof can be expressed in the cytoplasmic environment of *E. coli*. The cytoplasm is a reducing environment and for some molecules, this can result in the formation of insoluble inclusion bodies. Reducing agents such as dithiothreitol and β-mercaptoethanol and denaturants (e.g., such as guanidine-HCl and urea) can be used to resolubilize the proteins. An exemplary alternative approach is the expression of recombined antibodies or fragments thereof in the periplasmic space of bacteria which provides an oxidizing environment and chaperonin-like and disulfide isomerases leading to the production of soluble protein. Typically, a leader sequence is fused to the protein to be expressed which directs the protein to the periplasm. The leader is then removed by signal peptidases inside the periplasm. There are three major pathways to translocate expressed proteins into the periplasm, namely the Sec pathway, the SRP pathway and the TAT pathway. Examples of periplasmic-targeting leader sequences include the pelB leader from the pectate lyase gene, the StII leader sequence, and the DsbA leader sequence. An exemplary leader sequence is a DsbA leader sequence. In some cases, periplasmic expression allows leakage of the expressed protein into the culture medium. The secretion of proteins allows quick and simple purification from the culture supernatant. Proteins that are not secreted can be obtained from the periplasm by osmotic lysis. Similar to cytoplasmic expression, in some cases proteins can become insoluble and denaturants and reducing agents can be used to facilitate solubilization and refolding. Temperature of induction and growth also can influence expression levels and solubility. Typically, temperatures between 25° C. and 37° C. are used. Mutations also can be used to increase solubility of expressed proteins. Typically, bacteria produce aglycosylated proteins. Thus, if proteins require glycosylation for function, glycosylation can be added in vitro after purification from host cells.

b. Yeast

Yeasts such as *Saccharomyces cerevisiae, Schizosaccharomyces pombe, Yarrowia lipolytica, Kluyveromyces lactis*, and *Pichia pastoris* are useful expression hosts for recombined antibodies or portions thereof. Yeast can be transformed with episomal replicating vectors or by stable chromosomal integration by homologous recombination. Typically, inducible promoters are used to regulate gene expression.

Examples of such promoters include AOX1, GAL1, GAL7, and GAL5 and metallothionein promoters such as CUP1. Expression vectors often include a selectable marker such as LEU2, TRP1, HIS3, and URA3 for selection and maintenance of the transformed DNA. Proteins expressed in yeast are often soluble. Co-expression with chaperonins such as Bip and protein disulfide isomerase can improve expression levels and solubility. Additionally, proteins expressed in yeast can be directed for secretion using secretion signal peptide fusions such as the yeast mating type alpha-factor secretion signal from *Saccharomyces cerevisae* and fusions with yeast cell surface proteins such as the Aga2p mating adhesion receptor or the *Arxula adeninivorans* glucoamylase. A protease cleavage site such as for the Kex-2 protease, can be engineered to remove the fused sequences from the expressed polypeptides as they exit the secretion pathway. Yeast also is capable of glycosylation at Asn-X-Ser/Thr motifs.

c. Insects

Insect cells, particularly using baculovirus expression, are useful for expressing antibodies or portions thereof. Insect cells express high levels of protein and are capable of most of the post-translational modifications used by higher eukaryotes. Baculovirus have a restrictive host range which improves the safety and reduces regulatory concerns of eukaryotic expression. Typical expression vectors use a promoter for high level expression such as the polyhedrin promoter and p10 promoter of baculovirus. Commonly used baculovirus systems include the baculoviruses such as *Autographa californica* nuclear polyhedrosis virus (AcNPV), and the *Bombyx mori* nuclear polyhedrosis virus (BmNPV) and an insect cell line such as Sf9 derived from *Spodoptera frugiperda* and TN derived from *Trichoplusia ni*. For high-level expression, the nucleotide sequence of the molecule to be expressed is fused immediately downstream of the polyhedrin initiation codon of the virus. To generate baculovirus recombinants capable of expressing human antibodies, a dual-expression transfer, such as pAcUW51 (PharMingen) is utilized. Mammalian secretion signals are accurately processed in insect cells and can be used to secrete the expressed protein into the culture medium An alternative expression system in insect cells is the use of stably transformed cells. Cell lines such as Sf9 derived cells from *Spodoptera frugiperda* and TN derived cells from *Trichoplusia ni* can be used for expression. The baculovirus immediate early gene promoter IE1 can be used to induce consistent levels of expression. Typical expression vectors include the pIE1-3 and pI31-4 transfer vectors (Novagen). Expression vectors are typically maintained by the use of selectable markers such as neomycin and hygromycin.

d. Mammalian Cells

Mammalian expression systems can be used to express antibodies or portions thereof. Expression constructs can be transferred to mammalian cells by viral infection such as adenovirus or by direct DNA transfer such as liposomes, calcium phosphate, DEAE-dextran and by physical means such as electroporation and microinjection. Expression vectors for mammalian cells typically include an mRNA cap site, a TATA box, a translational initiation sequence (Kozak consensus sequence) and polyadenylation elements. Such vectors often include transcriptional promoter-enhancers for high-level expression, for example the SV40 promoter-enhancer, the human cytomegalovirus (CMV) promoter and the long terminal repeat of Rous sarcoma virus (RSV). These promoter-enhancers are active in many cell types. Tissue and cell-type promoters and enhancer regions also can be used for expression. Exemplary promoter/enhancer regions include, but are not limited to, those from genes such as elastase I, insulin, immunoglobulin, mouse mammary tumor virus, albumin, alpha fetoprotein, alpha 1 antitrypsin, beta globin, myelin basic protein, myosin light chain 2, and gonadotropic releasing hormone gene control. Selectable markers can be used to select for and maintain cells with the expression construct. Examples of selectable marker genes include, but are not limited to, hygromycin B phosphotransferase, adenosine deaminase, xanthine-guanine phosphoribosyl transferase, aminoglycoside phosphotransferase, dihydrofolate reductase and thymidine kinase. Antibodies are typically produced using a $NEO^R$/G418 system, a dihydrofolate reductase (DHFR) system or a glutamine synthetase (GS) system. The GS system uses joint expression vectors, such as pEE12/pEE6, to express both heavy chain and light chain. Fusion with cell surface signaling molecules such as TCR-$\zeta$ and Fc$_\epsilon$RI-$\gamma$ can direct expression of the proteins in an active state on the cell surface.

Many cell lines are available for mammalian expression including mouse, rat human, monkey, chicken and hamster cells. Exemplary cell lines include but are not limited to CHO, Balb/3T3, HeLa, MT2, mouse NS0 (nonsecreting) and other myeloma cell lines, hybridoma and heterohybridoma cell lines, lymphocytes, fibroblasts, Sp2/0, COS, NIH3T3, HEK293, 293S, 2B8, and HKB cells. Cell lines also are available adapted to serum-free media which facilitates purification of secreted proteins from the cell culture media. One such example is the serum free EBNA-1 cell line (Pham et al., (2003) *Biotechnol. Bioeng.* 84:332-42.)

e. Plants

Transgenic plant cells and plants can be used to express proteins such as any antibody or portion thereof described herein. Expression constructs are typically transferred to plants using direct DNA transfer such as microprojectile bombardment and PEG-mediated transfer into protoplasts, and with *agrobacterium*-mediated transformation. Expression vectors can include promoter and enhancer sequences, transcriptional termination elements and translational control elements. Expression vectors and transformation techniques are usually divided between dicot hosts, such as *Arabidopsis* and tobacco, and monocot hosts, such as corn and rice. Examples of plant promoters used for expression include the cauliflower mosaic virus CaMV 35S promoter, the nopaline synthase promoter, the ribose bisphosphate carboxylase promoter and the maize ubiquitin-1 (ubi-1) promoter promoters. Selectable markers such as hygromycin, phosphomannose isomerase and neomycin phosphotransferase are often used to facilitate selection and maintenance of transformed cells. Transformed plant cells can be maintained in culture as cells, aggregates (callus tissue) or regenerated into whole plants. Transgenic plant cells also can include algae engineered to produce proteases or modified proteases (see for example, Mayfield et al. (2003) *PNAS* 100:438-442). Because plants have different glycosylation patterns than mammalian cells, this can influence the choice of protein produced in these hosts.

3. Purification

Antibodies and portions thereof are purified by any procedure known to one of skill in the art. The recombined germline antibodies can be purified to substantial purity using standard protein purification techniques known in the art including but not limited to, SDS-PAGE, size fraction and size exclusion chromatography, ammonium sulfate precipitation, chelate chromatography, ionic exchange chromatography or column chromatography. For example, antibodies can be purified by column chromatography. Exemplary of a method to purify antibodies is by using column chromatography, wherein a solid support column material is linked to Protein G, a cell surface-associated protein from *Streptococcus*, that binds immunoglobulins with high affinity. The antibodies can be purified to 60%, 70%, 80% purity and typically at least 90%, 91%, 92%, 93%, 94%, 95%, 96%, 97%, 98% or 99% purity. Purity can be assessed by standard methods such as by SDS-PAGE and coomassie staining.

Methods for purification of recombined antibodies or portions thereof from host cells depend on the chosen host cells and expression systems. For secreted molecules, proteins are generally purified from the culture media after removing the cells. For intracellular expression, cells can be lysed and the proteins purified from the extract. When transgenic organisms such as transgenic plants and animals are used for expression, tissues or organs can be used as starting material to make a lysed cell extract. Additionally, transgenic animal production can include the production of polypeptides in milk or eggs, which can be collected, and if necessary further the proteins can be extracted and further purified using standard methods in the art.

When antibodies are expressed by transformed bacteria in large amounts, typically after promoter induction, although expression can be constitutive, the polypeptides can form insoluble aggregates. There are several protocols that are suitable for purification of polypeptide inclusion bodies known to one of skill in the art. Numerous variations will be apparent to those of skill in the art.

For example, in one method, the cell suspension is generally centrifuged and the pellet containing the inclusion bodies resuspended in buffer which does not dissolve but washes the inclusion bodies, e.g., 20 mM Tris-HCL (pH 7.2), 1 mM EDTA, 150 mM NaCl and 2% Triton-X 100, a non-ionic detergent. It can be necessary to repeat the wash step to remove as much cellular debris as possible. The remaining pellet of inclusion bodies can be resuspended in an appropriate buffer (e.g., 20 mM sodium phosphate, pH 6.8, 150 mM NaCl). Other appropriate buffers are apparent to those of skill in the art.

Alternatively, antibodies can be purified from bacteria periplasm. Where the polypeptide is exported into the periplasm of the bacteria, the periplasmic fraction of the bacteria can be isolated by cold osmotic shock in addition to other methods known to those of skill in the art. For example, in one method, to isolate recombinant polypeptides from the periplasm, the bacterial cells are centrifuged to form a pellet. The pellet is resuspended in a buffer containing 20% sucrose. To lyse the cells, the bacteria are centrifuged and the pellet is resuspended in ice-cold 5 mM $MgSO_4$ and kept in an ice bath for approximately 10 minutes. The cell suspension is centrifuged and the supernatant decanted and saved. The recombinant polypeptides present in the supernatant can be separated from the host proteins by standard separation techniques well known to those of skill in the art. These methods include, but are not limited to, the following steps: solubility fractionation, size differential filtration, and column chromatography.

H. Formulations, Administration and Articles Of Manufacture/Kits

1. Formulations

The antibodies provided herein can be provided as a formulation for administration. While it is possible for the active ingredient to be administered alone, it generally presented as a pharmaceutical formulation. Formulations comprise at least one active ingredient, together with one or more acceptable carriers thereof. Each carrier must be both pharmaceutically and physiologically acceptable in the sense of being compatible with the other ingredients and not injurious to the patient. Formulations include those suitable for oral, rectal, nasal, or parenteral (including subcutaneous, intramuscular, intravenous and intradermal) administration. The formulations can conveniently be presented in unit dosage form and can be prepared by methods well known in the art of pharmacy. See, e.g., Gilman, et al. (eds. 1990) Goodman and Gilman's: The Pharmacological Bases of Therapeutics, 8th Ed., Pergamon Press; and Remington's Pharmaceutical Sciences, 17th ed. (1990), Mack Publishing Co., Easton, Pa.; Avis, et al. (eds. 1993) Pharmaceutical Dosage Forms: Parenteral Medications Dekker, NY; Lieberman, et al. (eds. 1990) Pharmaceutical Dosage Forms: Tablets Dekker, NY; and Lieberman, et al. (eds. 1990) Pharmaceutical Dosage Forms: Disperse Systems Dekker, NY.

The route of antibody administration is in accord with known methods, e.g., injection or infusion by intravenous, intraperitoneal, intracerebral, intramuscular, subcutaneous, intraocular, intraarterial, intrathecal, inhalation or intralesional routes, topical or by sustained release systems as noted below. The antibody can be administered continuously by infusion or by bolus injection. One can administer the antibodies in a local or systemic manner.

The antibodies provided herein can be prepared in a mixture with a pharmaceutically acceptable carrier. Techniques for formulation and administration of the compounds of the instant application can be found in "Remington's Pharmaceutical Sciences," Mack Publishing Co., Easton, Pa., latest edition. This therapeutic composition can be administered intravenously or through the nose or lung, for example as a liquid or powder aerosol (lyophilized). The composition also can be administered parenterally or subcutaneously as desired. When administered systematically, the therapeutic composition generally is sterile, pyrogen-free and in a parenterally acceptable solution having due regard for pH, isotonicity, and stability. These conditions are known to those skilled in the art.

Therapeutic formulations can be administered in many conventional dosage formulations. Briefly, dosage formulations of the antibodies provided herein are prepared for storage or administration by mixing the compound having the desired degree of purity with physiologically acceptable carriers, excipients, or stabilizers. Such materials are non-toxic to the recipients at the dosages and concentrations employed, and can include buffers such as TRIS HCl, phosphate, citrate, acetate and other organic acid salts; antioxidants such as ascorbic acid; low molecular weight (less than about ten residues) peptides such as polyarginine, proteins, such as serum albumin, gelatin, or immunoglobulins; hydrophilic polymers such as polyvinylpyrrolidinone; amino acids such as glycine, glutamic acid, aspartic acid, or arginine; monosaccharides, disaccharides, and other carbohydrates including cellulose or its derivatives, glucose, mannose, or dextrins; chelating agents such as EDTA; sugar alcohols such as mannitol or sorbitol; counterions such as sodium and/or nonionic surfactants such as TWEEN, PLURONICS or polyethyleneglycol.

When used for in vivo administration, the antibody formulation must be sterile and can be formulated according to conventional pharmaceutical practice. This is readily accomplished by filtration through sterile filtration membranes, prior to or following lyophilization and reconstitution. The antibody ordinarily will be stored in lyophilized form or in solution. Other vehicles such as naturally occurring vegetable oil like sesame, peanut, or cottonseed oil or a synthetic fatty vehicle like ethyl oleate or the like can be desired. Buffers, preservatives, antioxidants and the like can be incorporated according to accepted pharmaceutical practice.

Pharmaceutical compositions suitable for use include compositions wherein one or more rationally designed antibodies are contained in an amount effective to achieve their intended purpose. Determination of a therapeutically effective amount is well within the capability of those skilled in the art. Therapeutically effective dosages can be determined by using in vitro and in vivo methods.

An effective amount of antibody to be employed therapeutically will depend, for example, upon the therapeutic objectives, the route of administration, and the condition of the patient. For example, antibodies provided herein include agonist and antagonist antibodies. In addition, the attending physician takes into consideration various factors known to modify the action of drugs including severity and type of disease, body weight, sex, diet, time and route of administration, other medications and other relevant clinical factors. Accordingly, it will be necessary for the therapist to titer the dosage and modify the route of administration as required to obtain the optimal therapeutic effect. Typically, the clinician will administer antibody until a dosage is reached that achieves the desired effect. The progress of this therapy is easily monitored by conventional assays.

For any antibody containing a peptide, the therapeutically effective dose can be estimated initially from cell culture assays. For example, a dose can be formulated in animal models to achieve a circulating concentration range that includes the EC50 as determined in cell culture (e.g., the concentration of the test molecule which promotes or inhibits cellular proliferation or differentiation). Such information can be used to more accurately determine useful doses in humans.

Toxicity and therapeutic efficacy of the antibody molecules described herein can be determined by standard pharmaceutical procedures in cell cultures or experimental animals, e.g., for determining the LD50 (the dose lethal to 50% of the population) and the ED50 (the dose therapeutically effective in 50% of the population). The dose ratio between toxic and therapeutic effects is the therapeutic index and it can be expressed as the ratio between LD50 and ED50. Molecules which exhibit high therapeutic indices can be used. The data obtained from these cell culture assays and animal studies can be used in formulating a range of dosage for use in human. The dosage of such molecules lies within a range of circulating concentrations that include the ED50 with little or no toxicity. The dosage can vary within this range depending upon the dosage form employed and the route of administration utilized. The exact formulation, route of administration and dosage can be chosen by the individual physician in view of the patient's condition. (See e.g., Fingl et al, 1975, in "The Pharmacological Basis of Therapeutics", Ch. 1, p. 1).

Dosage amount and interval can be adjusted individually to provide plasma levels of the antibody which are sufficient to promote or inhibit cellular proliferation or differentiation or minimal effective concentration (MEC). The MEC will vary for each antibody, but can be estimated from in vitro data using described assays. Dosages necessary to achieve the MEC will depend on individual characteristics and route of administration. HPLC assays or bioassays can be used to determine plasma concentrations. Dosage intervals can also be determined using MEC value. Antibody molecules can be administered using a regimen which maintains plasma levels above the MEC for 10-90% of the time, generally between 30-90%, for example between 50-90%. In cases of local administration or selective uptake, the effective local concentration of the antibody can not be related to plasma concentration.

The antibody is suitably administered to the patient at one time or over a series of treatments. Depending on the type and severity of the disease, from about 0.001 mg/kg to abut 1000 mg/kg, for example about 0.01 mg to 100 mg/kg, such as 0.010 to 20 mg/kg of the antibody, in particular about 1 µg/kg to 15 mg/kg (e.g. 0.1 mg/kg-10 mg/kg) is an initial candidate dosage for administration to the patient, whether, for example, by one or more separate administrations, or by continuous infusion. One typical daily dosage might range from about 1 µg/kg to 1000 mg/kg or more, for example, 1 µg/kg to 100 mg/kg or more, depending on the factors mentioned above. For repeated administrations over several days or longer, depending on the condition, the treatment is sustained until a desired suppression of disease symptoms occurs. One exemplary dosage of the antibody is in the range from about 0.05 mg/kg to about 10 mg/kg. Thus, one or more doses of about 0.5 mg/kg, 2.0 mg/kg, 4.0 mg/kg or 10 mg/kg (or any combination thereof) can be administered to the patient. Such doses can be administered intermittently, e.g. every week or every three weeks (e.g. such that the patient receives from about two to about twenty, e.g. about six doses of the antibody). An initial higher loading dose, followed by one or more lower doses can be administered. An exemplary dosing regimen includes administering an initial loading dose of about 4 mg/kg, followed by a weekly maintenance dose of about 2 mg/kg of the antibody. Other dosage regimens also can be employed. The progress of this therapy is readily monitored by conventional techniques and assays. Typically, the clinician administers the molecule until a dosage is reached that achieves the desired effect.

2. Articles of Manufacture and Kits

Pharmaceutical compounds of selected antibodies or nucleic acids encoding selected antibodies, or a derivative or a biologically active portion thereof can be packaged as articles of manufacture containing packaging material, a pharmaceutical composition which is effective for treating the disease or disorder, and a label that indicates that selected antibody or nucleic acid molecule is to be used for treating the disease or disorder.

The articles of manufacture provided herein contain packaging materials. Packaging materials for use in packaging pharmaceutical products are well known to those of skill in the art. See, for example, U.S. Pat. Nos. 5,323,907, 5,052,558 and 5,033,252, each of which is incorporated herein in its entirety. Examples of pharmaceutical packaging materials include, but are not limited to, blister packs, bottles, tubes, inhalers, pumps, bags, vials, containers, syringes, bottles, and any packaging material suitable for a selected formulation and intended mode of administration and treatment. A wide array of formulations of the compounds and compositions provided herein are contemplated as are a variety of treatments for any EPO-mediated disease or disorder or therapeutic polypeptide-mediated disease or disorder.

Antibodies and nucleic acid molecules encoding the antibodies thereof also can be provided as kits. Kits can include a pharmaceutical composition described herein and an item for administration. For example, a selected antibody can be supplied with a device for administration, such as a syringe, an inhaler, a dosage cup, a dropper, or an applicator. The kit can, optionally, include instructions for application including dosages, dosing regimens and instructions for modes of administration. Kits also can include a pharmaceutical composition described herein and an item for diagnosis. For example, such kits can include an item for measuring the concentration, amount or activity of the antibody in a subject.

I. Methods and Uses of Antibodies

The antibodies or portions thereof provided herein can be used in a variety of methods or uses based on the ability of the antibodies to specifically bind to DLL4. For example, antibodies provided herein that modulate an activity of DLL4 can be used for the treatment or prevention of disease states associated with expression and/or activity of DLL4. Antibodies also can be provided in combination with other therapeutic agents. Hence, combinations of anti-DLL4 antibodies and other therapeutic agents can be used in methods of treatment herein. Antibodies provided herein also can be used in detection or diagnostic methods.

1. Methods of Treatment and Uses

Provided herein are methods of treatment of uses of anti-DLL4 antibodies provided herein that specifically bind and/or modulate an activity of DLL4, such as increased expression and/or activity or undesired expression and/or activity (see e.g., U.S. Published Application Serial No. US20080175847 and International Published PCT Appl. No. WO2008060705, WO2008091222). Treatment includes neoplastic and non-neoplastic disorders. For example, the antibodies or portions thereof can be used to treat a tumor, a cancer (e.g. colon cancer, lung cancer or breast cancer) and/or a cell proliferative disorder and/or conditions associated with angiogenesis (e.g. intraocular neovascular disease). In particular, the antibodies or portions thereof can be used in combination with anti-VEGF therapies and/or in treatments that are resistant to anti-VEGF treatment.

Angiogenesis is implicated in the pathogenesis of a variety of disorders. These include solid tumors and metastasis, atherosclerosis, retrolental fibroplasia, hemangiomas, chronic inflammation, intraocular neovascular diseases such as proliferative retinopathies, e.g., diabetic retinopathy, age-related macular degeneration (AMD), neovascular glaucoma, immune rejection of transplanted corneal tissue and other tissues, rheumatoid arthritis, and psoriasis. Folkman et al., *J. Biol. Chem.* 267:10931-34 (1992); Klagsbrun et al., *Annu. Rev. Physiol.* 53:217-39 (1991); and Garner A., "Vascular diseases," In: Pathobiology of Ocular Disease. A Dynamic Approach, Garner A., Klintworth G K, eds., 2nd Edition (Marcel Dekker, NY, 1994), pp 1625-1710.

In the case of tumor growth, angiogenesis appears to be crucial for the transition from hyperplasia to neoplasia, and for providing nourishment for the growth and metastasis of the tumor. Folkman et al., *Nature* 339:58 (1989). The neovascularization allows the tumor cells to acquire a growth advantage and proliferative autonomy compared to the normal cells. A tumor usually begins as a single aberrant cell which can proliferate only to a size of a few cubic millimeters due to the distance from available capillary beds, and it can stay 'dormant' without further growth and dissemination for a long period of time. Some tumor cells then switch to the angiogenic phenotype to activate endothelial cells, which proliferate and mature into new capillary blood vessels. These newly formed blood vessels not only allow for continued growth of the primary tumor, but also for the dissemination and recolonization of metastatic tumor cells. Accordingly, a correlation has been observed between density of microvessels in tumor sections and patient survival in breast cancer as well as in several other tumors. Weidner et al., *N. Engl. J. Med.* 324:1-6 (1991); Horak et al., *Lancet* 340:1120-24 (1992); Macchiarini et al., *Lancet* 340:145-46 (1992). The precise mechanisms that control the angiogenic switch is not well understood, but it is believed that neovascularization of tumor mass results from the net balance of a multitude of angiogenesis stimulators and inhibitors (Folkman, *Nat. Med.* 1(1):27-31 (1995)).

In addition, antibodies or portions thereof can be used to treat non-neoplastic disorders including, but not limited to, undesired or aberrant hypertrophy, arthritis, rheumatoid arthritis (RA), psoriasis, psoriatic plaques, sarcoidosis, atherosclerosis, atherosclerotic plaques, edema from myocardial infarction, diabetic and other proliferative retinopathies including retinopathy of prematurity, retrolental fibroplasia, neovascular glaucoma, age-related macular degeneration, diabetic macular edema, corneal neovascularization, corneal graft neovascularization, corneal graft rejection, retinal/choroidal neovascularization, neovascularization of the angle (rubeosis), ocular neovascular disease, vascular restenosis, arteriovenous malformations (AVM), meningioma, hemangioma, angiofibroma, thyroid hyperplasias (including Grave's disease), corneal and other tissue transplantation, chronic inflammation, lung inflammation, acute lung injury/ARDS, sepsis, primary pulmonary hypertension, malignant pulmonary effusions, cerebral edema (e.g., associated with acute stroke/closed head injury/trauma), synovial inflammation, pannus formation in RA, myositis ossificans, hypertropic bone formation, osteoarthritis (OA), refractory ascites, polycystic ovarian disease, endometriosis, 3rd spacing of fluid diseases (pancreatitis, compartment syndrome, burns, bowel disease), uterine fibroids, premature labor, chronic inflammation such as IBD (Crohn's disease and ulcerative colitis), renal allograft rejection, inflammatory bowel disease, nephrotic syndrome, undesired or aberrant tissue mass growth (non-cancer), obesity, adipose tissue mass growth, hemophilic joints, hypertrophic scars, inhibition of hair growth, Osler-Weber syndrome, pyogenic granuloma retrolental fibroplasias, scleroderma, trachoma, vascular adhesions, synovitis, dermatitis, preeclampsia, ascites, pericardial effusion (such as that associated with pericarditis), and pleural effusion.

Combination Therapy

As indicated above, anti-DLL4 antibodies provided herein can be administered in combined therapies in which an anti-DLL4 antibody is administered with another therapy. US2009For example, anti-DLL4 antibodies are used in combinations with anti-cancer therapeutics or anti-neovascularization therapeutics to treat various neoplastic or non-neoplastic conditions. In one embodiment, the neoplastic or non-neoplastic condition is characterized by pathological disorder associated with aberrant or undesired angiogenesis. Exemplary combination therapies also include any set forth in U.S. Published application No. 20090246199. The anti-DLL4 antibody can be administered serially or in combination with another agent that is effective for those purposes, either in the same composition or as separate compositions. The anti-DLL4 antibodies can be administered sequentially, simultaneously or intermittently with a therapeutic agent. Alternatively, or additionally, multiple inhibitors of DLL4 can be administered.

The administration of the anti-DLL4 antibody can be done simultaneously, e.g., as a single composition or as two or more distinct compositions using the same or different administration routes. Alternatively, or additionally, the administration can be done sequentially, in any order. In certain embodiments, intervals ranging from minutes to days, to weeks to months, can be present between the administrations of the two or more compositions. For example, the anti-cancer agent can be administered first, followed by the DLL4 inhibitor. Simultaneous administration or administration of the anti-DLL4 antibody first also is contemplated.

The effective amounts of therapeutic agents administered in combination with an anti-DLL4 antibody will be at the physician's or veterinarian's discretion. Dosage administration and adjustment is done to achieve maximal management of the conditions to be treated. The dose will additionally depend on such factors as the type of therapeutic agent to be used and the specific patient being treated. Suitable dosages for the anti-cancer agent are those presently used and can be lowered due to the combined action (synergy) of the anti-cancer agent and the anti-DLL4 antibody. In certain embodiments, the combination of the inhibitors potentiates the efficacy of a single inhibitor.

Typically, the anti-DLL4 antibodies and anti-cancer agents are suitable for the same or similar diseases to block or reduce a pathological disorder such as tumor growth or growth of a cancer cell. In one embodiment the anti-cancer agent is an anti-angiogenesis agent. Antiangiogenic therapy in relationship to cancer is a cancer treatment strategy aimed at inhibiting the development of tumor blood vessels required for providing nutrients to support tumor growth. Because angiogenesis is involved in both primary tumor growth and metastasis, the antiangiogenic treatment is generally capable of inhibiting the neoplastic growth of tumor at the primary site as well as preventing metastasis of tumors at the secondary sites, therefore allowing attack of the tumors by other therapeutics.

Many anti-angiogenic agents have been identified and are known in the arts, including those listed herein, e.g., listed under Definitions, and by, e.g., Carmeliet and Jain, *Nature* 407:249-257 (2000); Ferrara et al., *Nature Reviews. Drug Discovery*, 3:391-400 (2004); and Sato *Int. J. Clin. Oncol.*, 8:200-206 (2003). See also, US Patent Application US20030055006. In one embodiment, an anti-DLL4 antibody is used in combination with an anti-VEGF neutralizing antibody (or fragment) and/or another VEGF antagonist or a VEGF receptor antagonist including, but not limited to, for example, soluble VEGF receptor (e.g., VEGFR-1, VEGFR-2, VEGFR-3, neuropillins (e.g., NRP1, NRP2)) fragments, aptamers capable of blocking VEGF or VEGFR, neutralizing anti-VEGFR antibodies, low molecule weight inhibitors of VEGFR tyrosine kinases (RTK), antisense strategies for VEGF, ribozymes against VEGF or VEGF receptors, antagonist variants of VEGF; and any combinations thereof. Alternatively, or additionally, two or more angiogenesis inhibitors can optionally be co-administered to the patient in addition to VEGF antagonist and other agent. In certain embodiment, one or more additional therapeutic agents, e.g., anti-cancer agents, can be administered in combination with anti-DLL4 antibody, the VEGF antagonist, and an anti-angiogenesis agent.

In certain aspects, other therapeutic agents useful for combination tumor therapy with a anti-DLL4 antibody include other cancer therapies, (e.g., surgery, radiological treatments (e.g., involving irradiation or administration of radioactive substances), chemotherapy, treatment with anti-cancer agents listed herein and known in the art, or combinations thereof). Alternatively, or additionally, two or more antibodies binding the same or two or more different antigens disclosed herein can be co-administered to the patient. Sometimes, it can be beneficial to also administer one or more cytokines to the patient.

For example, a method of blocking or reducing tumor growth or growth of a cancer cell, includes administering effective amounts of an antagonist of DLL4 and/or an angiogenesis inhibitor(s) and one or more chemotherapeutic agents to a patient susceptible to, or diagnosed with, cancer. A variety of chemotherapeutic agents can be used in the combined treatment methods. As will be understood by those of ordinary skill in the art, the appropriate doses of chemotherapeutic agents will be generally around those already employed in clinical therapies wherein the chemotherapeutics are administered alone or in combination with other chemotherapeutics. Variation in dosage will likely occur depending on the condition being treated. The physician administering treatment will be able to determine the appropriate dose for the individual subject.

2. Diagnosis and Detection

The anti-DLL4 antibodies provided herein are useful in assays detecting DLL4 expression (such as diagnostic or prognostic assays), for example, in specific cells or tissues. In such examples, antibodies can be labeled and/or immobilized on an insoluble matrix. For example, methods of diagnosing a disorder associated with DLL4 expression and/or activity is provided herein. The methods involve detecting DLL4-anti-DLL4 antibody complex in a biological sample from a patient having or suspected of having the disorder. In some embodiments, the DLL4 expression is increased expression or abnormal (undesired) expression. In some embodiments, the disorder is a tumor, cancer and/or a cell proliferative disorder.

In detection methods provided herein, the anti-DLL4 antibody is labeled generally with a detectable label (e.g. biotin, rubidium, fluorescent label or other label). Anti-DLL4 antibodies can be used for the detection of DLL4 in any one of a number of well known detection assay methods. For example, a biological sample can be assayed for DLL4 by obtaining the sample from a desired source (e.g. blood or serum or cellular preoparation), admixing the sample with anti-DLL4 antibody to allow the antibody to form antibody/DLL4 complex with any DLL4 present in the mixture, and detecting any antibody/DLL4 complex present in the mixture. The biological sample can be prepared fro assay by methods known in the art that are suitable for the particular sample. The methods of admixing the sample with antibodies and the methods of detecting antibody/DLL4 complex are chosen according to the type of assay used. Such assays include immunohistochemistry, competitive and sandwich assays and seteric inhibition assays.

The label can be any detectable functionality that does not interfere with the binding of DLL4 ant anti-DLL4 antibody. Numerous labels are known for use in immunoassay. Exemplary labels include moieties that can be detected directly, such as fluorochrome, chemiluminescent and radioactive labels, as well as moieties, such as enzymes, that must be reacted or derivatized to be detected. Examples of such labels include the radioisotopes $^{32}P$, $^{14}C$, $^{125}I$, $^{3}H$, and $^{131}I$, fluorophores such as rare earth chelates or fluorescein and its derivatives, rhodamine and its derivatives, dansyl, umbelliferone, luciferases, e.g. firefly luciferase and bacterial luciferase (U.S. Pat. No. 4,737,456), luciferin, 2,3,-dihydrophthalazinediones, horseradish peroxidase (HRP), alkaline phosphatase, β-galactosidase, glucoamylase, lysozyme, saccharide oxidases, e.g. glucose oxidase, galactose oxidase, and glucose-6-phosphate dehydrogenase, heterocyclic oxidases such as uricase and xanthine oxidase, couples with an enzyme that employs hydrogen peroxide to osidize a dye precursor such as HRP, lactoperoxidase, or microperoxidase, biotin/avidin, spin labels, bacteriophge labels and free radicals.

Conventional methods are available to bind these labels covalently to proteins or polypeptides. For instance, coupling agents such as dialdehydes, carbodiimides, dimaleimides, bis-imidates, bis-diazotized benzidine, can be used to tag the antibodies with the above-described fluorescent, chemiluminescent, and enzyme labels. See, for example, U.S. Pat. No. 3,940,475 (fluorimetry) and U.S. Pat. No. 3,645,090 (enzymes); Hunter et al., *Nature*, 144: 945 (1962); David et al., *Biochemistry*, 13: 1014-1021 (1974); Pain et al., *J. Immunol. Methods*, 40: 219-230 (1981); and Nygren, *J. Histochem. and Cytochem.*, 30: 407-412 (1982). Examples of labels are enzymes such as horseradish peroxidase and alkaline phosphatase. The conjugation of such label, including the enzymes, to the antibody is a standard manipulative procedure for one of ordinary skill in immunoassay techniques. See, for example, O'Sullivan et al., "Methods for the Preparation of Enzyme-antibody Conjugates for Use in Enzyme Immunoassay," in *Methods in Enzymology*, ed. J. J. Langone and H. Van Vunakis, Vol. 73 (Academic Press, New York, N.Y., 1981), pp. 147-166.

Immobilization of reagents is required for certain assay methods. Immobilization entails separating the anti-DLL4 antibody from any DLL4 that remains free in solution. This conventionally is accomplished by either insolubilizing the anti-DLL4 antibody or DLL4 analogue before the assay procedure, as by adsorption to a water-insoluble matrix or surface (Bennich et al., U.S. Pat. No. 3,720,760), by covalent coupling (for example, using glutaraldehyde cross-linking), or by insolubilizing the anti-DLL4 antibody or DLL4 analogue afterward, e.g., by immunoprecipitation.

The expression of proteins in a sample can be examined using immunohistochemistry and staining protocols. Immunohistochemical staining of tissue sections has been shown to be a reliable method of assessing or detecting presence of proteins in a sample. Immunohistochemistry ("IHC") techniques utilize an antibody to probe and visualize cellular antigens in situ, generally by chromogenic or fluorescent methods. For sample preparation, a tissue or cell sample from a mammal (typically a human patient) can be used. Examples of samples include, but are not limited to, cancer cells such as colon, breast, prostate, ovary, lung, stomach, pancreas, lymphoma, and leukemia cancer cells. The sample can be obtained by a variety of procedures known in the art including, but not limited to surgical excision, aspiration or biopsy. The tissue can be fresh or frozen. In one embodiment, the sample is fixed and embedded in paraffin. The tissue sample can be fixed (i.e. preserved) by conventional methodology. One of ordinary skill in the art will appreciate that the choice of a fixative is determined by the purpose for which the sample is to be histologically stained or otherwise analyzed. One of ordinary skill in the art will also appreciate that the length of fixation depends upon the size of the tissue sample and the fixative used.

IHC can be performed in combination with additional techniques such as morphological staining and/or fluorescence in-situ hybridization. Two general methods of IHC are available; direct and indirect assays. According to the first assay, binding of antibody to the target antigen (e.g., DLL4) is determined directly. This direct assay uses a labeled reagent, such as a fluorescent tag or an enzyme-labeled primary antibody, which can be visualized without further antibody interaction. In a typical indirect assay, unconjugated primary antibody binds to the antigen and then a labeled secondary antibody binds to the primary antibody. Where the secondary antibody is conjugated to an enzymatic label, a chromogenic or fluorogenic substrate is added to provide visualization of the antigen. Signal amplification occurs because several secondary antibodies can react with different epitopes on the primary antibody. The primary and/or secondary antibody used for immunohistochemistry typically are labeled with a detectable moiety. Numerous labels are available which can be generally grouped into the following categories:

Aside from the sample preparation procedures discussed above, further treatment of the tissue section prior to, during or following IHC can be desired. For example, epitope retrieval methods, such as heating the tissue sample in citrate buffer can be carried out (see, e.g., Leong et al. *Appl. Immunohistochem.* 4(3):201 (1996)).

Following an optional blocking step, the tissue section is exposed to primary antibody for a sufficient period of time and under suitable conditions such that the primary antibody binds to the target protein antigen in the tissue sample. Appropriate conditions for achieving this can be determined by routine experimentation. The extent of binding of antibody to the sample is determined by using any one of the detectable labels discussed above. The label can be an enzymatic label (e.g. HRP) which catalyzes a chemical alteration of the chromogenic substrate such as 3,3'-diaminobenzidine chromogen. The enzymatic label can be conjugated to antibody which binds specifically to the primary antibody (e.g. the primary antibody is rabbit polyclonal antibody and secondary antibody is goat anti-rabbit antibody). Specimens thus prepared are mounted and coverslipped.

Slide evaluation is then determined, e.g. using a microscope, and staining intensity criteria, routinely used in the art, can be employed. For example, a score of 2+ indicates weak to moderate staining observed in more than 10% of the cells. A score of 3+ is given where there is moderate to strong staining observed in more than 10% of the cells. Lesser scores are given for lesser staining, such as no staining (score of 0) or faint or barely perceptible staining (1+). Typically, a staining pattern score of about 2+ or higher in an IHC assay is diagnostic and/or prognostic. In some embodiments, a staining pattern score of about 1+ or higher is diagnostic and/or prognostic. In other embodiments, a staining pattern score of about 3 of higher is diagnostic and/or prognostic. It is understood that when cells and/or tissue from a tumor or colon adenoma are examined using IHC, staining is generally determined or assessed in tumor cell and/or tissue (as opposed to stromal or surrounding tissue that can be present in the sample).

Other assay methods, known as competitive or sandwich assays, are well established and widely used in the commercial diagnostics industry. For example, competitive assays rely on the ability of a tracer DLL4 analogue to compete with the test sample DLL4 for a limited number of anti-DLL4 antibody antigen-binding sites. The anti-DLL4 antibody generally is insolubilized before or after the competition and then the tracer and DLL4 bound to the anti-DLL4 antibody are separated from the unbound tracer and DLL4. This separation is accomplished by decanting (where the binding partner was preinsolubilized) or by centrifuging (where the binding partner was precipitated after the competitive reaction). The amount of test sample DLL4 is inversely proportional to the amount of bound tracer as measured by the amount of marker substance. Dose-response curves with known amounts of DLL4 are prepared and compared with the test results to quantitatively determine the amount of DLL4 present in the test sample. These assays are called ELISA systems when enzymes are used as the detectable markers.

Another example of a competitive assay, called a "homogeneous" assay, does not require a phase separation. Here, a conjugate of an enzyme with the DLL4 is prepared and used such that when anti-DLL4 antibody binds to the DLL4 the presence of the anti-DLL4 antibody modifies the enzyme activity. In this case, the DLL4 or its immunologically active fragments are conjugated with a bifunctional organic bridge to an enzyme such as peroxidase. Conjugates are selected for use with anti-DLL4 antibody so that binding of the anti-DLL4 antibody inhibits or potentiates the enzyme activity of the label. This method per se is widely practiced under the name of EMIT.

Steric conjugates are used in steric hindrance methods for homogeneous assay. These conjugates are synthesized by covalently linking a low-molecular-weight hapten to a small DLL4 fragment so that antibody to hapten is substantially unable to bind the conjugate at the same time as anti-DLL4 antibody. Under this assay procedure the DLL4 present in the test sample will bind anti-DLL4 antibody, thereby allowing anti-hapten to bind the conjugate, resulting in a change in the character of the conjugate hapten, e.g., a change in fluorescence when the hapten is a fluorophore.

Sandwich assays particularly are useful for the determination of DLL4 or anti-DLL4 antibodies. In sequential sandwich assays an immobilized anti-DLL4 antibody is used to adsorb test sample DLL4, the test sample is removed as by washing, the bound DLL4 is used to adsorb a second, labeled anti-DLL4 antibody and bound material is then separated from residual tracer. The amount of bound tracer is directly proportional to test sample DLL4. In "simultaneous" sandwich assays the test sample is not separated before adding the labeled anti-DLL4. A sequential sandwich assay using an anti-DLL4 monoclonal antibody as one antibody and a polyclonal anti-DLL4 antibody as the other is useful in testing samples for DLL4.

J. EXAMPLES

The following examples are included for illustrative purposes only and are not intended to limit the scope of the invention.

Example 1

Cloning of Germline Fab Antibodies

In this Example, Fab antibodies were generated by cloning heavy or light chain variable region DNA into their respective plasmids.

A. Generation of Heavy and Light Chain Germline Recombined DNA Sequences

Germline-derived antibodies were generated as described in U.S. Provisional Application Ser. Nos. 61/198,764 and 61/211,204, incorporated by reference herein. Briefly, $V_H$, $D_H$ and $J_H$ germline segments were compiled, in frame, to generate a nucleic acid sequence encoding a VH chain. Following compilation of germline segment sequences, restriction enzyme sites NcoI (SEQ ID NO:108) and NheI (SEQ ID NO:109) were included at the 5' and 3' end, respectively, of the nucleic acid sequence encoding the VH chain to allow for subcloning into appropriate vectors as described below. Similarly, Vκ and Jκ or $V_\lambda$ and $J_\lambda$ were compiled, in frame, to generate a nucleic acid sequence encoding a VL chain. Following compilation of Vκ and Jκ germline segment sequences, restriction enzyme sites for NcoI and BsiWI (SEQ ID NO:110) were included at the 5' and 3' end, respectively, of the nucleic acid sequence encoding the VL chain to allow for subcloning into appropriate vectors. Alternatively, following compilation of $V_\lambda$ and $J_\lambda$ germline segment sequences, restriction enzyme sites NcoI and Avr II (SEQ ID NO:111) were included at the 5' and 3' end, respectively, of the nucleic acid sequence encoding the VL chain to allow for subcloning into appropriate vectors. The compiled nucleic acid sequences were sent to a DNA synthesis vendor (Genscript Corp.) to generate synthetic antibody variable heavy and light chain sequences. Exemplary nucleic acid sequences encoding VH chain are set forth in Table 9. Exemplary nucleic acid sequences encoding VL chain are set forth in Table 10.

TABLE 9

Exemplary Compiled Heavy Chain Nucleic Acid Sequences

| Heavy Chain | SEQ ID NO |
|---|---|
| VH1-46__IGHD6-6*01__IGHJ1*01 | 88 |
| VH5-51__IGHD5-18*01 > 3__IGHJ4*01 | 89 |
| VH6-1__IGHD3-3*01__IGHJ4*01 | 90 |
| VH1-46__IGHD6-13*01__IGHJ4*01 | 92 |
| VH4-34__IGHD7-27*01__IGHJ4*01 | 94 |
| VH1-3__IGHD4-23*01__IGHJ4*01 | 95 |
| VH1-46__IGHD2-15*01__IGHJ2*01 | 93 |
| VH1-46__IGHD3-10*01__IGHJ4*01 | 91 |
| VH1-8__IGHD2-2*01__IGHJ6*01 | 96 |
| VH4-31__IGHD2-15*01__IGHJ2*01 | 97 |

TABLE 10

Exemplary Compiled Light Chain Nucleic Acid Sequences

| Light Chain | SEQ ID NO |
|---|---|
| L6__IGKJ1*01 | 98 |
| V3-4__IGLJ1*01 | 99 |
| V4-3__IGLJ4*01 | 100 |
| L2__IGKJ1*01 | 102 |
| L5__IGKJ1*01 | 103 |
| A27__IGKJ1*01 | 101 |
| L12__IGKJ1*01 | 104 |
| O1__IGKJ1*01 | 105 |
| V1-4__IGLJ4*01 | 106 |
| V4-6__IGLJ4*01 | 107 |

B. Cloning of Variable Heavy and Light Chains

DNA encoding a heavy or light chain variable region was cloned into plasmids containing constant heavy or light chains as appropriate for co-transformation and expression of combinatorial Fabs. Plasmid A (SEQ ID NO:84) and plasmid D (SEQ ID NO:85) contain heavy chain constant regions sequences. Plasmid C (SEQ ID NO:86) contains a kappa light chain constant region sequence and Plasmid E (SEQ ID NO:87) contains a lambda light chain constant region sequence.

DNA encoding a variable heavy chain was digested with Nhe I and Nco I and ligated into Plasmid A with a StII leader sequence using standard molecular techniques. DNA encoding a variable kappa light chain was digested with NcoI and BsiWI and DNA encoding a variable lambda chain was digested with NcoI and AvrII, and were ligated into Plasmid C or Plasmid E, respectively, with a StII leader sequence, using standard molecular biology techniques.

Example 2

Expression and Purification of Antibody Fabs

A. Co-Transformation

Plasmid A and one of either Plasmid C or Plasmid E, each containing various combinations of variable heavy and light chains, were co-transformed into *E. coli*. The process was repeated for all combinations of heavy and light chains. Briefly, plasmid A (encoding a Fab heavy chain) and plasmid C or Plasmid E (encoding a Fab light chain) were resuspended separately in TE buffer to a final concentration of 1 ng/μl. One (1) μL of heavy chain plasmid and 1 μL of light chain plasmid were combined in a PCR tube or a PCR plate and were mixed with 20 μL ice cold LMG194 competent cells. The transformation reaction was incubated on ice for 10 minutes followed by heat shock in a preheated PCR block at 42° C. for 45 seconds. The tube was then placed on ice for an additional 2 minutes followed by addition of 200 μL SOC medium. The cells were allowed to recover for 1.5 hours at 37° C. A 100 μL aliquot of the transformation culture was used to inoculate 0.9 mL LB (Luria-Bertani Broth) containing 0.4% (w/v) glucose, 17 μg/mL kanamycin (Sigma Aldrich) and 34 μg/mL chloramphenicol (Sigma Aldrich). The culture was grown at 30° C. with vigorous shaking for 20 hours. The transformation culture was grown and purified using the Piccolo™ system as described in Example 10.

B. High throughput Growth and Purification of Fab Antibodies

Following transformation, the cells were grown overnight in 2 ml deep well 96-well plates (VWR) block covered with breathable tape. The overnight culture was used directly for inoculation in Piccolo™ (Wollerton et al. (2006) JALA, 11:291-303.)

High throughput, parallel expression and purification of Fab antibodies was performed using Piccolo™ (The Automation Partnership (TAP)), which automates protein expression and purification. The expression and purification parameters for Piccolo™ were prepared using Run Composer software (TAP). A 'Strain File' was generated mapping the location of each clone in the seed culture plate. This was submitted to the Run Composer software and the basic machine settings were set as follows: Pre-induction Incubator set at 30° C.; Expression Incubator 1 set at 16° C.; Centrifuge set at 6° C. and 5000×g; Media Pump 1 primed with TB (Terrific Broth; per liter contains 12 g tryptone, 24 g yeast extract, 9.4 g potassium phosphate, dibasic, and 2.2 g potassium phosphate, monobasic) (EMD Biosciences; catalog No. 71754), 50 μg/mL kanamycin (Sigma Aldrich), 35 μg/mL chloramphenicol (Sigma Aldrich), 0.4% (w/v) glucose (Sigma Aldrich) and 0.015% (v/v) Antifoam 204 (Sigma Aldrich); Inducer Pump 1 primed with 0.2% (w/v) arabinose (EMD Biosciences); Incubator Gassing Rate set at 2 sec with 51% oxygen, 0.1 mL inoculation volume; Induction Statistic Mean set w/o Outliers (i.e. block mean $OD_{600}$ determined after excluding the 3 highest and 3 lowest values); culture vessel blocks (CVB) pre-induction delay set at 1 hr 20 min and Expression Incubator Acclimatization set at 30 min.

The seed cultures were prepared and loaded into Piccolo™ along with the necessary labware: 24-well culture vessel blocks (CVBs; The Automation Partnership), 24-well Filter Plates (The Automation Partnership), 24-well Output Plates (Seahorse Bioscience) and Pipette Tip Boxes (MBP) as specified by the manufacturer. The TB media supplemented as described above, arabinose inducer and associated pumps were prepared under sterile conditions and attached to the machine. The centrifuge counterbalance weight was set and placed inside the centrifuge. Lastly, purification reagents were prepared and attached to the system pumps (lysis buffer, resin, wash buffer and elution buffer as described below). Once this was complete, the machine was started and processing began.

Before inoculation, the inocula were mapped to specific wells of 24-well CVB, and expression and induction conditions were set as described below. Each well of the CVBs was filled with 10 mL of TB media supplemented as described above prior to inoculation from the seed plate. Each well of each CVB was inoculated with 0.1 mL seed culture and then returned to the storage carousel to await scheduled admission to pre-induction incubation. Once a CVB was queued to begin pre-induction incubation it was removed from the storage carousel and coupled to an aeration assembly (which provides agitation, well sealing and a means for controlled administration of oxygen/air) and then placed in the pre-induction incubator set at 30° C. $OD_{600}$ readings were taken upon commencement of incubation and approximately every 30 minutes thereafter. Piccolo operation control software monitors the $OD_{600}$ measurements to predict when each CVB will reach the 1.0 $OD_{600}$ set point. Approximately 30 minutes prior to the CVB reaching the $OD_{600}$ set point the assembly was moved to the expression incubator to equilibrate to the expression temperature of 20° C., and then the cultures in the CVB were induced by addition of 0.032% arabinose inducer followed by 45 hours of expression.

Following culture inoculation and growth induction of cultures, the cells were harvested and lysed for purification of Fabs. Piccolo™ was used for purification of the expressed Fab proteins using an automated expression and purification 'Lifecycle' of a whole culture purification. After controlled expression, CVBs were chilled for 30 minutes at 6° C. in the storage carousel prior to lysis. The CVB was moved to the liquid handling bed and lysis buffer (2.5 mL of Popculture with 1:1000 Lysonase (EMD Biosciences)) was added to each well with thorough mixing. The lysis proceeded for 10 minutes and then the CVB was centrifuged for 10 minutes at 5000×g to pellet cell debris. During centrifugation, a Filter Plate was placed in the filter bed and resin (2 mL of a 50% slurry of Ni-charged His-Bind resin (EMD Biosciences)) was added to each well. Soluble lysate was added to the corresponding wells of the filter plate containing resin and allowed to bind for 10 minutes prior to draining to waste. Wash buffer (12 mL of wash buffer (50 mM Sodium Phosphate, 300 mM NaCl, 30 mM Imidazole, pH 8.0)) was added in two steps to each well and allowed to drain to waste. Finally, an Output Plate was placed under the Filter Plate in the filter bed and IMAC elution buffer (50 mM Sodium Phosphate, 300 mM NaCl, 500 mM Imidazole) was added in two steps draining into the output plate. The output plate was returned to the storage carousel as was all other labware. Once this process was complete for each CVB in the designed run, the machine was unloaded.

C. Orthogonal Secondary Purification of Fab Antibodies

To rapidly further purify partially pure Fabs generated after the Piccolo™ process, an orthogonal method of purification was developed. Fabs were expressed and purified as described above using the Piccolo™ machine.

Two different affinity resins were used depending on the light chain classes. Fabs with a kappa light chain were further purified on Protein G column (GE Healthcare), and Fabs with a lambda light chain were further purified on CaptureSelect Fab Lambda affinity column (BAC, Netherlands). First, the protein samples were transferred to a deep well 96-well block (VWR). Approximately 1.8 mL of the IMAC elution per Fab sample was purified on either a 1 mL Hi-Trap Protein G column or a 0.5 mL CaptureSelect Fab Lambda affinity column at 4° C. using the Akta purifier (GE Healthcare) and A-905 autosampler (GE Healthcare) according to the manufacturer's protocol. Protein concentration was determined by measuring absorbance at A280 on a Molecular Dynamic plate reader and calculated from the exctinction coefficient of the corresponding Fab. Extinction coefficients are calculated based on the total numbers of Tyrosine+Tryptophane+Phenylalanine in the Fab heavy and light chains. Following purification using the Piccolo™ system, expressed protein was generally less than 20% pure. After orthogonal purification with protein G, Fab purity was greater than 95% pure as indicated by SDS-PAGE.

Example 3

Identification of Anti-DLL4 Antibodies Derived from Germline Segments

Antibodies derived from germline segments were generated and purified as described in Examples 1 and 2 and testing for binding to DLL4 using a Multispot electrochemiluminescence (ECL) binding assay. In the ECL binding assay, germline-derived Fab antibodies were screened for binding to nine different antigens, including the human epidermal growth factor 2 receptor (ErbB2), epidermal growth factor receptor (EGF R), hepatocyte growth factor receptor (HGF R/c-Met), Notch-1, CD44, insulin-like growth factor-1 soluble receptor (IGF-1 sR), P-cadherin, erythropoietin receptor (Epo R) and delta-like protein 4 (DLL4). In an ECL assay, an antigen-antibody interaction is detected by addition of a detection antibody labeled with ruthenium tri-bispyridine-(4-methysulfone) (Ru(bpy)$_2^{2+}$). Upon application of an electric current, the Ru(bpy)$_2^{2+}$-label undergoes an oxidation-reduction cycle in the presence of a co-reactant and light is emitted. A signal is only generated when the Ru(bpy)$_2^{2+}$-label is in close proximity to the electrode, eliminating the need for washing. Detected light intensity is proportional to the amount of captured protein. Those antibodies that showed an ECL signal for DLL4 that was 4 times the signal to a blank well containing no protein antigen were identified.

Recombinant proteins were immobilized onto each well of a 96-well plate by spotting 50 nanoliters (nl) of each protein (of a 60 μg/mL antigen) on the surface of a 96-well Multi-Spot 10 Highbind plate (Meso Scale Discovery; Gaithersburg Md.). Spot 10 was left blank as a control. The recombinant human proteins were obtained from R&D Systems and included: rHuman ErbB2/Fc Chimera, CF (Cat# 1129-ER); rHuman EGF R/Fc Chimera, CF (Cat# 344-ER); rHuman HGF R/c-MET/Fc Chimera, CF (Cat# 358-MT/CF); rHuman Notch-1/Fc Chimera, CF (Cat# 3647-TK); rHuman CD44/Fc Chimera, CF (Cat# 3660-CD); rHuman IGF-1 sR, (IGF-1 sR), CF (Cat# 391-GR); rHuman P-Cadherin/Fc Chimera, CF (Cat# 861-PC); rHuman Erythropoietin R/Fc Chimera, CF (Cat# 963-ER); and Recombinant Human DLL4 (Cat# 1506-D4/CF).

An 150 μl aliquot of 1% Bovine Serum Albumin (BSA) in Tris-buffered Saline Tween (TBST) was added to each well and allowed to incubate for 30 min at 20° C. followed by washing and tap drying to completely remove any residual solution. Subsequently, a 12.5 μl aliquot of 1% BSA TBST was added to each well followed by the addition of a 12.5 μl aliquot of a purified Fab. The plate was sealed and incubated for 1 hour at 20° C. with shaking.

Detection antibodies were prepared by individually conjugating both goat anti-human Kappa light chain polyclonal antibody (K3502-1MG, Sigma-Aldrich) and goat anti-human Lambda light chain polyclonal antibody (L1645-1 mL, Sigma-Aldrich) with Ruthenium (II) tris-bipyridine-(4-methylsulfone)-N-hydroxysuccinimide (SULFO-TAG NHS-ester, Meso Scale Discovery) according to the manufacturer's instructions. TAG-detection antibody at 25 μl was added to each well and allowed to incubate for 1 hour at 20° C. with shaking. Finally, 15 μl of Read Buffer P with Surfactant (Cat # R92PC-1, Meso Scale Discovery) was added to each well. The electrochemiluminescence was measured using a Sector Imager 2400 (Meso Scale Discovery). Data was analyzed by comparing the ECL signals for an antigen to the blank of each well. A signal to blank ratio of 4 or more was considered a "Hit" Fab.

Table 11, below, lists the Fabs (including the heavy chain and light chain) that were identified as "hits" in the initial ECL screen and the target(s) of the identified Fab "hit." All of the Fabs bind to DLL4. Additionally, as is indicated in Table 11 below, several Fabs were identified that bind to multiple targets. For example, Fab VH1-46_IGHD2-15*01_IGHJ2*01 & L12_IGKJ1*01 binds to EGF R, Epo R and DLL4 and Fab VH1-46_IGHD3-10*01_IGHJ4*01 & L12_IGKJ1*01 binds to Notch-1, P-cadherin and DLL4.

TABLE 11

IDENTIFIED FAB "HITS"

| Target | Heavy Chain | SEQ ID NO | Light Chain | SEQ ID NO |
|---|---|---|---|---|
| rHuman DLL4 | VH1-46_IGHD6-6*01_IGHJ1*01 | 131 | L6_IGKJ1*01 | 141 |
| rHuman DLL4 | VH5-51_IGHD5-18*01 > 3_IGHJ4*01 | 132 | V3-4_IGLJ1*01 | 142 |
| rHuman DLL4 | VH6-1_IGHD3-3*01_IGHJ4*01 | 133 | V4-3_IGLJ4*01 | 143 |
| EGF R/Fc chimera, Notch-1/Fc chimera, P-cadherin/Fc chimera, Epo R/Fc chimera and rHuman DLL4 | VH1-46_IGHD6-13*01_IGHJ4*01 | 135 | L2_IGKJ1*01 | 145 |
| rHuman DLL4 | VH4-34_IGHD7-27*01_IGHJ4*01 | 137 | L5_IGKJ1*01 | 146 |
| Notch-1/Fc chimera, P-cadherin/Fc chimera, Epo R/Fc chimera and rHuman DLL4 | VH1-46_IGHD6-13*01_IGHJ4*01 | 135 | A27_IGKJ1*01 | 144 |
| rHuman DLL4 | VH1-3_IGHD4-23*01_IGHJ4*01 | 138 | L12_IGKJ1*01 | 147 |
| EGF R/Fc chimera, Epo R/Fc chimera and rHuman DLL4 | VH1-46_IGHD2-15*01_IGHJ2*01 | 136 | L12_IGKJ1*01 | 147 |
| Notch-1/Fc chimera, P-cadherin/Fc chimera and rHuman DLL4 | VH1-46_IGHD3-10*01_IGHJ4*01 | 134 | L12_IGKJ1*01 | 147 |
| rHuman DLL4 | VH1-8_IGHD2-2*01_IGHJ6*01 | 139 | L12_IGKJ1*01 | 147 |
| Epo R/Fc chimera and rHuman DLL4 | VH1-46_IGHD6-13*01_IGHJ4*01 | 135 | O1_IGKJ1*01 | 148 |
| rHuman DLL4 | VH4-34_IGHD7-27*01_IGHJ4*01 | 137 | V1-4_IGLJ4*01 | 149 |
| rHuman DLL4 | VH4-31_IGHD2-15*01_IGHJ2*01 | 140 | V1-4_IGLJ4*01 | 149 |
| rHuman DLL4 | VH4-34_IGHD7-27*01_IGHJ4*01 | 137 | V4-6_IGLJ4*01 | 150 |

To confirm a "Hit" from the initial Multispot ECL screening, a Fab concentration dependent titration was carried out to determine the Fab-antigen binding affinity. The Multispot ECL assay procedure was the same as described above, except that the concentration of Fab antibody was varied between wells from 0.1 nM to 2.4 µM as indicated in the Tables below depending on each Fab tested. The data are set forth in Tables 12-25 below.

TABLE 12

Binding affinity of Fab VH1-46_IGHD6-6*01_IGHJ1*01 & L6_IGKJ1*01

| | Fab [nM] | | | | | | |
|---|---|---|---|---|---|---|---|
| | 2383 | 595.8 | 148.9 | 37.2 | 9.3 | 2.3 | 0.6 | 0.1 |
| ErbB2/Fc | 454 | 321 | 247 | 384 | 354 | 291 | 215 | 306 |
| EGF R/Fc | 621 | 403 | 290 | 228 | 424 | 289 | 309 | 311 |
| HGF R/Fc | 762 | 353 | 205 | 207 | 324 | 253 | 256 | 286 |
| Notch-1/Fc | 690 | 306 | 375 | 402 | 492 | 333 | 337 | 378 |
| CD44/Fc | 559 | 372 | 348 | 356 | 396 | 317 | 238 | 323 |
| IGF-1 sR | 527 | 335 | 322 | 295 | 315 | 231 | 313 | 241 |
| P-Cadherin/Fc | 728 | 617 | 687 | 649 | 452 | 401 | 321 | 235 |
| EPO R/Fc | 658 | 378 | 373 | 315 | 306 | 429 | 337 | 373 |
| DLL4 | 11794 | 17203 | 16253 | 16717 | 13210 | 3055 | 508 | 317 |
| Blank | 344 | 285 | 218 | 199 | 287 | 234 | 226 | 201 |

TABLE 13

Binding affinity of Fab VH5-51_IGHD5-18*01 > 3_IGHJ4*01 & V3-4_IGLJ1*01

| | Fab [nM] | | | |
|---|---|---|---|---|
| | 154 | 51 | 17 | 6 |
| ErbB2/Fc | 1593 | 1248 | 1033 | 873 |
| EGF R/Fc | 1398 | 816 | 805 | 742 |
| HGF R/Fc | 1520 | 1044 | 914 | 831 |
| Notch-1/Fc | 929 | 685 | 558 | 464 |
| CD44/Fc | 960 | 651 | 518 | 547 |
| IGF-1 sR | 1396 | 1051 | 872 | 854 |
| P-Cadherin/Fc | 1733 | 854 | 542 | 358 |
| EPO R/Fc | 1195 | 750 | 620 | 548 |
| DLL4 | 40392 | 17025 | 7158 | 1946 |
| Blank | 447 | 335 | 143 | 191 |

TABLE 14

Binding affinity of Fab VH6-1_IGHD3-3*01_IGHJ4*01 & V4-3_IGLJ4*01

| | Fab [nM] | | | | | | | |
|---|---|---|---|---|---|---|---|---|
| | 480 | 240 | 120 | 60 | 30 | 15 | 7.5 | 3.8 |
| ErbB2/Fc | 965 | 833 | 822 | 777 | 726 | 713 | 695 | 714 |
| EGF R/Fc | 877 | 690 | 658 | 679 | 585 | 584 | 582 | 511 |
| HGF R/Fc | 951 | 834 | 785 | 623 | 640 | 694 | 558 | 519 |
| Notch-1/Fc | 545 | 368 | 472 | 415 | 425 | 508 | 392 | 383 |
| CD44/Fc | 541 | 470 | 442 | 434 | 484 | 454 | 444 | 419 |
| IGF-1 sR | 741 | 625 | 813 | 654 | 697 | 705 | 642 | 463 |
| P-Cadherin/Fc | 596 | 383 | 450 | 372 | 440 | 351 | 352 | 281 |
| EPO R/Fc | 621 | 478 | 431 | 423 | 325 | 397 | 443 | 407 |
| DLL4 | 1532 | 1273 | 938 | 875 | 736 | 690 | 598 | 462 |
| Blank | 362 | 316 | 363 | 237 | 213 | 261 | 217 | 198 |

TABLE 15

Binding affinity of Fab VH1-46__IGHD6-13*01__IGHJ4*01 & L2__IGKJ1*01

| | Fab [μM] | | | |
|---|---|---|---|---|
| | 1.19 | 0.2975 | 0.07438 | 0.01859 |
| ErbB2/Fc | 38410 | 15111 | 7551 | 5531 |
| EGF R/Fc | 62454 | 42213 | 16605 | 11750 |
| HGF R/Fc | 45494 | 17396 | 6611 | 4566 |
| Notch-1/Fc | 72018 | 37503 | 21990 | 17565 |
| CD44/Fc | 47145 | 28601 | 10922 | 7322 |
| IGF-1 sR | 35187 | 17389 | 5804 | 3779 |
| P-Cadherin/Fc | 69710 | 26043 | 14807 | 11672 |
| EPO R/Fc | 192967 | 167064 | 153692 | 188065 |
| DLL4 | 74900 | 34726 | 20719 | 18888 |
| Blank | 24999 | 5019 | 2504 | 1776 |

TABLE 16

Binding affinity of Fab VH4-34__IGHD7-27*01__IGHJ4*01 & L5__IGKJ1*01

| | Fab [μM] | | | |
|---|---|---|---|---|
| | 0.51 | 0.1275 | 0.03188 | 0.00797 |
| ErbB2/Fc | 1532 | 857 | 584 | 493 |
| EGF R/Fc | 2363 | 1061 | 694 | 530 |
| HGF R/Fc | 1989 | 853 | 693 | 419 |
| Notch-1/Fc | 2773 | 1497 | 849 | 654 |
| CD44/Fc | 2012 | 926 | 653 | 490 |
| IGF-1 sR | 2236 | 1045 | 765 | 564 |
| P-Cadherin/Fc | 2389 | 957 | 775 | 502 |
| EPO R/Fc | 2624 | 1067 | 789 | 566 |
| DLL4 | 5183 | 2382 | 1282 | 872 |
| Blank | 1096 | 530 | 536 | 364 |

TABLE 17

Binding affinity of Fab VH1-46__IGHD6-13*01__IGHJ4*01 & A27__IGKJ1*01

| | Fab [μM] | | |
|---|---|---|---|
| | 0.48 | 0.096 | 0.0192 |
| ErbB2/Fc | 11287 | 3365 | 2313 |
| EGF R/Fc | 14638 | 4509 | 3115 |
| HGF R/Fc | 8002 | 2328 | 1582 |
| Notch-1/Fc | 15931 | 4802 | 3041 |
| CD44/Fc | 13445 | 4320 | 2915 |
| IGF-1 sR | 8927 | 2449 | 1826 |
| P-Cadherin/Fc | 15595 | 6654 | 5040 |
| EPO R/Fc | 70938 | 57356 | 62037 |
| DLL4 | 16065 | 5586 | 3555 |
| Blank | 2945 | 917 | 751 |

TABLE 18

Binding affinity of Fab VH1-3__IGHD4-23*01__IGHJ4*01 & L12__IGKJ1*01

| | Fab [nM] | | | |
|---|---|---|---|---|
| | 60 | 15 | 3.75 | 0.9375 |
| ErbB2/Fc | 2155 | 740 | 291 | 268 |
| EGF R/Fc | 2563 | 842 | 371 | 224 |
| HGF R/Fc | 2298 | 743 | 394 | 243 |
| Notch-1/Fc | 2886 | 1058 | 375 | 348 |
| CD44/Fc | 2355 | 748 | 307 | 251 |
| IGF-1 sR | 2666 | 859 | 314 | 204 |
| P-Cadherin/Fc | 2662 | 837 | 331 | 191 |
| EPO R/Fc | 3214 | 970 | 358 | 238 |
| DLL4 | 17270 | 7728 | 1569 | 453 |
| Blank | 1433 | 536 | 191 | 153 |

TABLE 19

Binding affinity of Fab VH1-46__IGHD2-15*01__IGHJ2*01 & L12__IGKJ1*01

| | Fab [nM] | | | |
|---|---|---|---|---|
| | 280 | 70 | 17.5 | 4.375 |
| ErbB2/Fc | 3953 | 1358 | 541 | 384 |
| EGF R/Fc | 6667 | 2574 | 1305 | 542 |
| HGF R/Fc | 3564 | 1289 | 565 | 193 |
| Notch-1/Fc | 4382 | 1492 | 680 | 480 |
| CD44/Fc | 4069 | 1370 | 664 | 424 |
| IGF-1 sR | 3533 | 1319 | 626 | 369 |
| P-Cadherin/Fc | 5400 | 1817 | 949 | 469 |
| EPO R/Fc | 8496 | 2485 | 1262 | 594 |
| DLL4 | 8111 | 2747 | 1219 | 558 |
| Blank | 1691 | 635 | 304 | 305 |

TABLE 20

Binding affinity of Fab VH1-46__IGHD3-10*01__IGHJ4*01 & L12__IGKJ1*01

| | Fab [nM] | | | |
|---|---|---|---|---|
| | 920 | 230 | 57.5 | 14.375 |
| ErbB2/Fc | 10924 | 4078 | 2447 | 1594 |
| EGF R/Fc | 13406 | 5723 | 3858 | 2672 |
| HGF R/Fc | 10708 | 3934 | 2297 | 1600 |
| Notch-1/Fc | 20086 | 9737 | 5886 | 4206 |
| CD44/Fc | 9698 | 3817 | 2313 | 1488 |
| IGF-1 sR | 10246 | 4764 | 2833 | 1746 |
| P-Cadherin/Fc | 16666 | 6484 | 4110 | 2318 |
| EPO R/Fc | 16429 | 6949 | 4038 | 2718 |
| DLL4 | 73638 | 119436 | 144126 | 125422 |
| Blank | 4082 | 1656 | 954 | 738 |

TABLE 21

Binding affinity of Fab VH1-8__IGHD2-2*01__IGHJ6*01 & L12__IGKJ1*01

| | Fab [nM] | | | |
|---|---|---|---|---|
| | 130 | 32.5 | 8.1 | 2.0 |
| ErbB2/Fc | 1533 | 556 | 557 | 382 |
| EGF R/Fc | 1746 | 645 | 560 | 424 |
| HGF R/Fc | 1882 | 525 | 551 | 356 |
| Notch-1/Fc | 1759 | 706 | 612 | 539 |
| CD44/Fc | 1754 | 573 | 528 | 447 |
| IGF-1 sR | 1973 | 561 | 518 | 367 |
| P-Cadherin/Fc | 1845 | 556 | 573 | 250 |
| EPO R/Fc | 2151 | 673 | 660 | 433 |
| DLL4 | 7738 | 2989 | 1548 | 605 |
| Blank | 1153 | 473 | 435 | 316 |

TABLE 22

Binding affinity of Fab VH1-46_IGHD6-13*01_IGHJ4*01 & O1_IGKJ1*01

| | Fab [nM] | | | |
|---|---|---|---|---|
| | 930 | 232.5 | 58.1 | 14.5 |
| ErbB2/Fc | 2225 | 779 | 322 | 274 |
| EGF R/Fc | 3110 | 803 | 444 | 357 |
| HGF R/Fc | 2344 | 790 | 432 | 373 |
| Notch-1/Fc | 2206 | 778 | 388 | 317 |
| CD44/Fc | 1917 | 607 | 375 | 212 |
| IGF-1 sR | 1915 | 569 | 343 | 234 |
| P-Cadherin/Fc | 2438 | 655 | 478 | 277 |
| EPO R/Fc | 3009 | 1472 | 829 | 660 |
| DLL4 | 8162 | 3586 | 1876 | 1149 |
| Blank | 1206 | 460 | 225 | 117 |

TABLE 23

Binding affinity of Fab VH4-34_IGHD7-27*01_IGHJ4*01 & V1-4_IGLJ4*01

| | Fab [nM] | | | |
|---|---|---|---|---|
| | 580 | 145 | 36.3 | 9.1 |
| ErbB2/Fc | 1712 | 1123 | 1029 | 987 |
| EGF R/Fc | 1631 | 856 | 831 | 800 |
| HGF R/Fc | 2341 | 1173 | 1065 | 894 |
| Notch-1/Fc | 1585 | 860 | 633 | 754 |
| CD44/Fc | 1228 | 692 | 629 | 607 |
| IGF-1 sR | 1364 | 794 | 799 | 788 |
| P-Cadherin/Fc | 2240 | 850 | 684 | 589 |
| EPO R/Fc | 1579 | 845 | 722 | 697 |
| DLL4 | 4420 | 2140 | 1399 | 1030 |
| Blank | 679 | 357 | 314 | 276 |

TABLE 24

Binding affinity of Fab VH4-31_IGHD2-15*01_IGHJ2*01 & V1-4_IGLJ4*01

| | Fab [nM] | | | |
|---|---|---|---|---|
| | 210 | 52.5 | 13.1 | 3.3 |
| ErbB2/Fc | 1977 | 1511 | 930 | 1031 |
| EGF R/Fc | 1617 | 1109 | 824 | 847 |
| HGF R/Fc | 2060 | 1286 | 981 | 849 |
| Notch-1/Fc | 1972 | 1323 | 669 | 726 |
| CD44/Fc | 1395 | 897 | 708 | 621 |
| IGF-1 sR | 1431 | 911 | 814 | 743 |
| P-Cadherin/Fc | 4410 | 2161 | 1062 | 678 |
| EPO R/Fc | 2123 | 1319 | 776 | 695 |
| DLL4 | 4108 | 1951 | 1107 | 922 |
| Blank | 833 | 467 | 376 | 359 |

TABLE 25

Binding affinity of Fab VH4-34_IGHD7-27*01_IGHJ4*01 & V4-6_IGLJ4*01

| | Fab [nM] | | | |
|---|---|---|---|---|
| | 340 | 170 | 85.0 | 42.5 |
| ErbB2/Fc | 1226 | 964 | 844 | 866 |
| EGF R/Fc | 1208 | 826 | 1001 | 528 |
| HGF R/Fc | 1238 | 757 | 998 | 607 |
| Notch-1/Fc | 1209 | 816 | 780 | 649 |
| CD44/Fc | 959 | 660 | 693 | 522 |
| IGF-1 sR | 1042 | 832 | 891 | 646 |
| P-Cadherin/Fc | 1160 | 744 | 709 | 421 |
| EPO R/Fc | 1255 | 790 | 817 | 494 |
| DLL4 | 2332 | 1462 | 1311 | 877 |
| Blank | 554 | 262 | 292 | 162 |

Example 4

Germline-Modified Anti-DLL4 Antibodies

Anti-DLL4 antibodies derived from germline segments were used to generate germline-modified anti-DLL4 antibodies. Modifications were made in the VH and/or VL chains of germline-derived anti-DLL4 antibodies as described in U.S. provisional Application No. [nickname 3800016-00004/p702], and incorporated by reference herein.

A. Alignment with Non-Hit and Alanine-scanning Mutagenesis

Briefly, the amino acid sequence of the heavy and/or light chain of a germline-derived antibody identified as a "Hit" by binding to DLL4 was compared to the amino acid sequence of the heavy and/or light chain of a germline-derived antibody that was identified as a "non-Hit" for DLL4. The region of the antibody containing amino acid residues that differed between the "Hit" and "non-Hit" was subjected to alanine-scanning mutagenesis. Alanine mutants were generated by overlapping PCR using the parent heavy or light chain DNA as a template. Forward and reverse primers that specifically generate the desire mutation at the target codon were used to amplify the parent DNA in the appropriate plasmid. In the first round of PCR, two separate PCR reactions with different primer pairs were used to amplify two segments of the gene. The first reaction used the specific reverse primer with an EcoRI forward primer and amplified the first half of the gene. The second reaction used the specific forward primer with an FLXhoI reverse primer and amplified the second half of the gene. The gene segments were generated using 20 cycles of PCR with the following conditions: 94° C. for 30 sec; 50° C. for 30 sec; and 72° C. for 90 sec. The PCR products were isolated and purified from 1% agarose gel and mixed together as a template for the second round of PCR. In the second round of PCR, EcoRI forward and FLXhoI reverse primers were used to amplify the full length gene product. The gene product was generated using 20 cycles of PCR with the following conditions: 94° C. for 30 sec; 55° C. for 30 sec; and 72° C. for 90 sec.

The PCR product was isolated and subsequently digested with EcoRI and XhoI (New England Biolabs) and ligated into the similarly digested plasmid. After transformation of the ligation product in *E. coli* DH5a and plating, individual colonies were selected and grown in a 96-well block containing 1.5 ml of Terrific Broth (EMD, San Diego, Calif.) supplemented with 50 µg/ml Kanamycin, and 0.4% glucose, and grown at 37° C. overnight. The DNA was isolated using a mini-prep kit (Qiagen) and alanine mutations were confirmed by DNA sequencing.

As an example, Table 26 sets forth primer pairs used to generate the mutant VH5-51_IGHD5-18*01>3_IGHJ4*01 R99A and VH1-46_IGHD6-6*01_IGHJ1*01 E100A. Primers R99A_F and R99A_R were utilized to specifically amplify the $R_{99}$ to alanine mutation. Primers E100A_F and E100A_R were utilized to specifically amplify the E100 to alanine mutation. Primers EcoRI_F and FLXhoI_R were utilized to amplify the remaining segments of the gene.

restriction site was incorporated at both the 5' and 3' end of each CDR region. To generate Fab mutants, forward and reverse primers encoding a CDR with specific mutations and additionally BsaI overlapping ends were synthesized and

TABLE 26

Example primer pairs for alanine scanning mutagenesis

| Primer | Sequence | SEQ ID NO |
|---|---|---|
| VH5-51_IGHD5-18*01 > 3_IGHJ4*01 | | |
| R99A_F | GCCATGTATTACTGTGCGAGAGCCGGATACAGCTATGGTTACGAC | 1 |
| R99A_R | GTCGTAACCATAGCTGTATCCGGCTCTCGCACAGTAATACATGGC | 2 |
| VH1-46_IGHD6-6*01_IGHJ1*01 | | |
| E100A_F | GTGTATTACTGTGCGAGAGAGGCCTATAGCAGCTCGTCCGCTG | 3 |
| E100A_R | CAGCGGACGAGCTGCTATAGGCCTCTCTCGCACAGTAATACAC | 4 |
| Plasmid A and D | | |
| EcoRI_F | TTGGGCGAATTCCCTAGATAATTAATTAGGAGG | 5 |
| FLXhoI_R | TTAAACCTCGAGCCGCGGTTCATTAAAG | 6 |

B. NNK Mutagenesis by Overlapping PCR

Following alanine scanning mutagenesis, expressed Fab antibodies were tested for binding to DLL4 using the ECL assay described in Example 3 above. The Fab antibodies that contained modifications in the VH and/or VL chain that did not affect or increased binding to DLL4 were subjected to further mutagenesis. NNK mutagenesis by overlapping PCR was carried out as described above for alanine scanning mutagenesis, with initial primers that generate the desired NNK mutations. Therefore, in the first round of PCR, specific primer pairs were used in which the target codon was replaced with NNK (forward) and MNN (reverse). For example, Table 27 below sets forth forward and reverse primers used to generate VH5-51_IGHD5-18*01>3_IGHJ4*01 G100 NNK mutants and VH1-46_IGHD6-6*01_IGHJ1*01 S102 NNK mutants.

Individual clones were subjected to DNA sequencing (by BATJ, Inc., San Diego, Calif.) to identify the amino acid substitution. Depending on the number of colonies picked per NNK mutation reaction, mutation rate varies—as low as 4 to 5 amino acid changes, and as high as 18 to 19 amino acid changes per mutation were observed.

annealed. These cassettes, or mutated CDR regions, were then ligated into the corresponding BsaI digested vector, thereby generating a plasmid containing a specifically modified CDR region.

For example, specific primers were synthesized (IDT, see Table 28 below) and used to generate three vectors each for germline-derived heavy chains VH1-46_IGHD6-6*01_IGHJ1*01 and VH5-51_IGHD5-18*01>3_IGHJ4*01 and light chains L6_IGKJ1*01 and V3-4_IGLJ1*01, to incorporate a BsaI site at the beginning and end of CDR1, CDR2 and CDR3. The vectors were generated as described above using the specific forward and reverse primers in the first round of PCR and the parent heavy or light chain DNA as a template. Individual clones were subjected to DNA sequencing (by BATJ, Inc., San Diego, Calif.) to confirm the incorporation of two BsaI sites in each CDR.

Subsequently, each BsaI containing plasmid was digested with BsaI (New England Biolabs) and the DNA was gel purified. Specific primers were synthesized (IDT) to generate desired mutants. Briefly, 1 μl of each forward and reverse primer were annealed by heating to 95° C. in TE for 2 min, followed by slow cooling to room temperature. 1 μl of the

TABLE 27

Example primer pairs for NNK mutagenesis

| Primer | Sequence | SEQ ID NO |
|---|---|---|
| VH5-51_IGHD5-18*01 > 3_IGHJ4*01 | | |
| G100_NNK_F | GTATTACTGTGCGAGACGTNNKTACAGCTATGGTTACGAC | 7 |
| G100_NNK_R | GTCGTAACCATAGCTGTAMNNACGTCTCGCACAGTAATAC | 8 |
| VH1-46_IGHD6-6*01_IGHJ1*01 | | |
| S102_NNK_F | TGCGAGAGAGGGGTATNNKAGCAGCTGGTACGACT | 9 |
| S102_NNK_R | AGTCGTACCAGCTGCTMNNATACCCCTCTCTCGCA | 10 |

C. Cassette Mutagenesis

Following identification of modifications in the VH and/or VL chain that optimized binding to DLL4, cassette mutagenesis was used to generate particular combination mutants. Briefly, Fab mutants were generated in a high-throughput manner by cloning of specific synthetic CDR1, CDR2 and/or CDR3 sequences into plasmids previously modified to contain BsaI cloning sites. Specifically, for each heavy or light chain, three vectors each were generated whereby a BsaI annealed primers were then ligated with 2 ng of the BsaI digested vector and transformed into E. coli DH5a cell. Mutations were confirmed by DNA sequencing. The ligation reactions can be carried out in a 96-well plate thereby allowing for high-throughput mutagenesis.

For example, Tables 28-29 below set forth primers to generate VH1-46_IGHD6-6*01_IGHJ1*01_APFF CDR2 mutants set forth in Example 5, Table 30 below.

TABLE 28

BsaI restriction enzyme mutagenesis primers

| Primer | Sequence | SEQ ID NO |
|---|---|---|
| VH1-46_C_DR1_F | gagacctactatggttcgggtctctgggtgcgacaggcc | 11 |
| VH1-46_C_DR2_F | gagacctactatggttcgggtctcaagttccagggcagagtcac | 12 |
| VH1-46_C_DR3_F | gagacctactatggttcgggtctctggggccagggcac | 13 |
| VH5-51_C_DR1_F | gagacctactatggttcgggtctctggtgcgccagatg | 14 |
| VH5-51_C_DR2_F | gagacctactatggttcgggtctccaggtcaccatctcagccg | 15 |
| VH5-51_C_DR3_F | gagacctactatggttcgggtctctggggccaaggaaccc | 16 |
| L6_CDR1_F | gagacctactatggttcgggtctctggtaccaacagaaacctggc | 17 |
| L6_CDR2_F | gagacctactatggttcgggtctcggcatcccagccagg | 18 |
| L6_CDR3_F | gagacctactatggttcgggtctcttcggccaagggacca | 19 |
| V3-4_CDR1_F | gagacctactatggttcgggtctctggtaccagcagacccca | 20 |
| V3-4_CDR2_F | gagacctactatggttcgggtctcggggtccctgatcgcttc | 21 |
| V3-4_CDR3_F | gagacctactatggttcgggtctcttcggaactgggaccaag | 22 |
| Lambda_BSA_F | gagtggagacgaccacaccc | 23 |
| VH1-46_C_DR1_R | GAGACCCGAACCATAGTAGGTCTCAGATGCCTTGCAGGAAACC | 24 |
| VH1-46_C_DR2_R | GAGACCCGAACCATAGTAGGTCTCTCCCATCCACTCAAGCCC | 25 |
| VH1-46_C_DR3_R | GAGACCCGAACCATAGTAGGTCTCTCGCACAGTAATACACGGC | 26 |
| VH5-51_C_DR1_R | GAGACCCGAACCATAGTAGGTCTCAGAACCCTTACAGGAGATCTTCA | 27 |
| VH5-51_C_DR2_R | GAGACCCGAACCATAGTAGGTCTCCCCCATCCACTCCAGGC | 28 |
| VH5-51_C_DR3_R | GAGACCCGAACCATAGTAGGTCTCTCGCACAGTAATACATGGC | 29 |
| L6_CDR1_R | GAGACCCGAACCATAGTAGGTCTCGCAGGAGAGGGTGGCTC | 30 |
| L6_CDR2_R | GAGACCCGAACCATAGTAGGTCTCATAGATGAGGAGCCTGGGAG | 31 |
| L6_CDR3_R | GAGACCCGAACCATAGTAGGTCTCACAGTAATAAACTGCAAAATCTTCAG | 32 |
| V3-4_CDR1_R | GAGACCCGAACCATAGTAGGTCTCACAAGTGAGTGTGACTGTCCCT | 33 |
| V3-4_CDR2_R | GAGACCCGAACCATAGTAGGTCTCGTAGATGAGCGTGCGTGG | 34 |
| V3-4_CDR3_R | GAGACCCGAACCATAGTAGGTCTCACAGTAATAATCAGATTCATCATCTGC | 35 |

TABLE 29

VH1-46_IGHD6-6*01_IGHJ1*01_APFF_CDR2 BsaI mutagenesis primers

| Primer | Sequence | SEQ ID NO |
|---|---|---|
| A_ILPTH_F | tgggaataattctccctactggtcatagcacaagctacgcacaga | 36 |
| A_VLPTH_F | tgggaatagtgctccctactggtcatagcacaagctacgcacaga | 37 |
| A_ALPTH_F | tgggaatagctctccctactggtcatagcacaagctacgcacaga | 38 |
| A_GLPTH_F | tgggaataggcctccctactggtcatagcacaagctacgcacaga | 39 |
| A_TLPTH_F | tgggaataaccctccctactggtcatagcacaagctacgcacaga | 40 |
| A_SLPTH_F | tgggaatatcccctccctactggtcatagcacaagctacgcacaga | 41 |
| A_YLPTH_F | tgggaatataccctccctactggtcatagcacaagctacgcacaga | 42 |
| A_WLPTH_F | tgggaatatggctccctactggtcatagcacaagctacgcacaga | 43 |
| A_HLPTH_F | tgggaataccaccctccctactggtcatagcacaagctacgcacaga | 44 |

TABLE 29 -continued

VH1-46_IGHD6-6*01_IGHJ1*01_APFF_CDR2 BsaI mutagenesis primers

| Primer | Sequence | SEQ ID NO |
|---|---|---|
| A_RLPTH_F | tgggaatacgcctccctactggtcatagcacaagctacgcacaga | 45 |
| A_ELPTH_F | tgggaatagaactccctactggtcatagcacaagctacgcacaga | 46 |
| A_NLPTH_F | tgggaataaacctccctactggtcatagcacaagctacgcacaga | 47 |
| A_TLVTH_F | tgggaataaccctcgtgactggtcatagcacaagctacgcacaga | 48 |
| A_TLATH_F | tgggaataaccctcgctactggtcatagcacaagctacgcacaga | 49 |
| A_TLGTH_F | tgggaataaccctcggcactggtcatagcacaagctacgcacaga | 50 |
| A_TLTTH_F | tgggaataaccctcaccactggtcatagcacaagctacgcacaga | 51 |
| A_TLSTH_F | tgggaataaccctctccactggtcatagcacaagctacgcacaga | 52 |
| A_TLYTH_F | tgggaataaccctctacactggtcatagcacaagctacgcacaga | 53 |
| A_TLWTH_F | tgggaataaccctctggactggtcatagcacaagctacgcacaga | 54 |
| A_TLHTH_F | tgggaataaccctccacactggtcatagcacaagctacgcacaga | 55 |
| A_TLRTH_F | tgggaataaccctccgcactggtcatagcacaagctacgcacaga | 56 |
| A_TLETH_F | tgggaataaccctcgaaactggtcatagcacaagctacgcacaga | 57 |
| A_TLNTH_F | tgggaataaccctcggcactggtcatagcacaagctacgcacaga | 58 |
| A_TLMTH_F | tgggaataaccctcatgactggtcatagcacaagctacgcacaga | 59 |
| A_ILPTH_R | AACTTCTGTGCGTAGCTTGTGCTATGACCAGTAGGGAGAATTATT | 60 |
| A_VLPTH_R | AACTTCTGTGCGTAGCTTGTGCTATGACCAGTAGGGAGCACTATT | 61 |
| A_ALPTH_R | AACTTCTGTGCGTAGCTTGTGCTATGACCAGTAGGGAGAGCTATT | 62 |
| A_GLPTH_R | AACTTCTGTGCGTAGCTTGTGCTATGACCAGTAGGGAGGCCTATT | 63 |
| A_TLPTH_R | AACTTCTGTGCGTAGCTTGTGCTATGACCAGTAGGGAGGGTTATT | 64 |
| A_SLPTH_R | AACTTCTGTGCGTAGCTTGTGCTATGACCAGTAGGGAGGGATATT | 65 |
| A_YLPTH_R | AACTTCTGTGCGTAGCTTGTGCTATGACCAGTAGGGAGGTATATT | 66 |
| A_WLPTH_R | AACTTCTGTGCGTAGCTTGTGCTATGACCAGTAGGGAGCCATATT | 67 |
| A_HLPTH_R | AACTTCTGTGCGTAGCTTGTGCTATGACCAGTAGGGAGGTGTATT | 68 |
| A_RLPTH_R | AACTTCTGTGCGTAGCTTGTGCTATGACCAGTAGGGAGGCGTATT | 69 |
| A_ELPTH_R | AACTTCTGTGCGTAGCTTGTGCTATGACCAGTAGGGAGTTCTATT | 70 |
| A_NLPTH_R | AACTTCTGTGCGTAGCTTGTGCTATGACCAGTAGGGAGGTTTATT | 71 |
| A_TLVTH_R | AACTTCTGTGCGTAGCTTGTGCTATGACCAGTCACGAGGGTTATT | 72 |
| A_TLATH_R | AACTTCTGTGCGTAGCTTGTGCTATGACCAGTAGCGAGGGTTATT | 73 |
| A_TLGTH_R | AACTTCTGTGCGTAGCTTGTGCTATGACCAGTGCCGAGGGTTATT | 74 |
| A_TLTTH_R | AACTTCTGTGCGTAGCTTGTGCTATGACCAGTGGTGAGGGTTATT | 75 |
| A_TLSTH_R | AACTTCTGTGCGTAGCTTGTGCTATGACCAGTGGAGAGGGTTATT | 76 |
| A_TLYTH_R | AACTTCTGTGCGTAGCTTGTGCTATGACCAGTGTAGAGGGTTATT | 77 |
| A_TLWTH_R | AACTTCTGTGCGTAGCTTGTGCTATGACCAGTCCAGAGGGTTATT | 78 |
| A_TLHTH_R | AACTTCTGTGCGTAGCTTGTGCTATGACCAGTGTGGAGGGTTATT | 79 |
| A_TLRTH_R | AACTTCTGTGCGTAGCTTGTGCTATGACCAGTGCGGAGGGTTATT | 80 |
| A_TLETH_R | AACTTCTGTGCGTAGCTTGTGCTATGACCAGTTTCGAGGGTTATT | 81 |

TABLE 29 -continued

VH1-46_IGHD6-6*01_IGHJ1*01_APFF_CDR2 BsaI mutagenesis primers

| Primer | Sequence | SEQ ID NO |
|---|---|---|
| A_TLNTH_R | AACTTCTGTGCGTAGCTTGTGCTATGACCAGTGCCGAGGGTTATT | 82 |
| A_TLMTH_R | AACTTCTGTGCGTAGCTTGTGCTATGACCAGTCATGAGGGTTATT | 83 |

Example 5

Germline-Modified Anti-DLL4 Antibodies

Table 30 sets forth germline-modified anti-DLL4 antibodies derived from parent anti-DLL4 antibody encoded by VH chain germline segments VH1-46_IGHD6-6*01_IGHJ1*01 and VL chain germline segments L6_IGKJ1*01. Table 31 sets forth germline-modified anti-DLL4 antibodies derived from parent anti-DLL4 antibody encoded by VH chain germline segments VH5-51_IGHD5-18*01>3_IGHJ4*01 and VL chain germline segments V3-4_IGLJ1*01. The amino acid mutation(s) is numbered according to its amino acid position in the parent wild-type antibody. The SEQ ID NO corresponding to the amino acid sequence of each heavy chain and light chain is provided.

TABLE 30

| | | Heavy Chain | SEQ | Light Chain | SEQ |
|---|---|---|---|---|---|
| | Nickname | VH1-46_IGHD6-6*01_IGHJ1*01 | ID NO | L6_IGKJ1*01 | ID NO |
| 1 | | wildtype | 131 | wildtype | 141 |
| 2 | H: S104F & L: wt | S104F | 151 | wildtype | 141 |
| 3 | H: S104A & L: wt | S104A | 152 | wildtype | 141 |
| 4 | H: S103P & L: wt | S103P | 153 | wildtype | 141 |
| 5 | H: S102A & L: wt | S102A | 154 | wildtype | 141 |
| 6 | H: APF & L: wt | S102A/S103P/S104F | 155 | wildtype | 141 |
| 7 | H: APFF & L: wt | S102A/S103P/S104F/H111F | 156 | wildtype | 141 |
| 8 | H: APFY & L: wt | S102A/S103P/S104F/H111Y | 157 | wildtype | 141 |
| 9 | H: APYY & L: wt | S102A/S103P/S104Y/H111Y | 158 | wildtype | 141 |
| 10 | H: APF & L: wt | S102A/S103P/S104F | 155 | S28P | 264 |
| 11 | H: APF & L: wt | S102A/S103P/S104F | 155 | S30N | 265 |
| 12 | H: APF & L: wt | S102A/S103P/S104F | 155 | S31K | 266 |
| 13 | H: E100A & L: wt | E100A | 159 | wildtype | 141 |
| 14 | H: Y101A & L: wt | Y101A | 160 | wildtype | 141 |
| 15 | H: S103A & L: wt | S103A | 161 | wildtype | 141 |
| 16 | H: S105A & L: wt | S105A | 162 | wildtype | 141 |
| 17 | H: E107A & L: wt | E107A | 163 | wildtype | 141 |
| 18 | H: Q110A & L: wt | Q110A | 164 | wildtype | 141 |
| 19 | H: H111A & L: wt | H111A | 165 | wildtype | 141 |
| 20 | H: S102Q & L: wt | S102Q | 166 | wildtype | 141 |
| 21 | H: S102V & L: wt | S102V | 167 | wildtype | 141 |
| 22 | H: S102I & L: wt | S102I | 168 | wildtype | 141 |
| 23 | H: S102G & L: wt | S102G | 169 | wildtype | 141 |
| 24 | H: S103L & L: wt | S103L | 170 | wildtype | 141 |
| 25 | H: S103W & L: wt | S103W | 171 | wildtype | 141 |
| 26 | H: S103F & L: wt | S103F | 172 | wildtype | 141 |
| 27 | H: S103N & L: wt | S103N | 173 | wildtype | 141 |
| 28 | H: S103H & L: wt | S103H | 174 | wildtype | 141 |
| 29 | H: S103C & L: wt | S103C | 175 | wildtype | 141 |
| 30 | H: S103G & L: wt | S103G | 176 | wildtype | 141 |
| 31 | H: S104G & L: wt | S104G | 177 | wildtype | 141 |
| 32 | H: S104C & L: wt | S104C | 178 | wildtype | 141 |
| 33 | H: S104H & L: wt | S104H | 179 | wildtype | 141 |
| 34 | H: S104L & L: wt | S104L | 180 | wildtype | 141 |
| 35 | H: S104R & L: wt | S104R | 181 | wildtype | 141 |
| 36 | H: APF G55W & L: wt | S102A/S103P/S104F G55W | 182 | wildtype | 141 |
| 37 | H: APF G55D & L: wt | S102A/S103P/S104F G55D | 183 | wildtype | 141 |
| 38 | H: APF A106E & L: wt | S102A/S103P/S104F A106E | 184 | wildtype | 141 |
| 39 | H: APF H111S & L: wt | S102A/S103P/S104F H111S | 185 | wildtype | 141 |
| 40 | H: APFF T28A & L: wt | S102A/S103P/S104F/H111F T28A | 186 | wildtype | 141 |
| 41 | H: APFF F29A & L: wt | S102A/S103P/S104F/H111F F29A | 187 | wildtype | 141 |
| 42 | H: APFF T30A & L: wt | S102A/S103P/S104F/H111F T30A | 188 | wildtype | 141 |
| 43 | H: APFF S31A & L: wt | S102A/S103P/S104F/H111F S31A | 189 | wildtype | 141 |
| 44 | H: APFF Y33A & L: wt | S102A/S103P/S104F/H111F Y33A | 190 | wildtype | 141 |
| 45 | H: APFF I50A & L: wt | S102A/S103P/S104F/H111F I50A | 191 | wildtype | 141 |
| 46 | H: APFF I51A & L: wt | S102A/S103P/S104F/H111F I51A | 192 | wildtype | 141 |
| 47 | H: APFF N52A & L: wt | S102A/S103P/S104F/H111F N52A | 193 | wildtype | 141 |
| 48 | H: APFF P53A & L: wt | S102A/S103P/S104F/H111F P53A | 194 | wildtype | 141 |
| 49 | H: APFF S54A & L: wt | S102A/S103P/S104F/H111F S54A | 195 | wildtype | 141 |
| 50 | H: APFF G55A & L: wt | S102A/S103P/S104F/H111F G55A | 196 | wildtype | 141 |
| 51 | H: APFF G56A & L: wt | S102A/S103P/S104F/H111F G56A | 197 | wildtype | 141 |

TABLE 30-continued

VH1-46_IGHD6-6*01_IGHJ1*01 & L6_IGKJ1*01 DLL4 antibodies

| | Nickname | Heavy Chain VH1-46_IGHD6-6*01_IGHJ1*01 | SEQ ID NO | Light Chain L6_IGKJ1*01 | SEQ ID NO |
|---|---|---|---|---|---|
| 52 | H: APFF S57A & L: wt | S102A/S103P/S104F/H111F S57A | 198 | wildtype | 141 |
| 53 | H: APFF T58A & L: wt | S102A/S103P/S104F/H111F T58A | 199 | wildtype | 141 |
| 54 | H: APFF S59A & L: wt | S102A/S103P/S104F/H111F S59A | 200 | wildtype | 141 |
| 55 | H: APFF TV & L: wt | S102A/S103P/S104F/H111F I51T/N52V | 201 | wildtype | 141 |
| 56 | H: APFF N52G & L: wt | S102A/S103P/S104F/H111F N52G | 202 | wildtype | 141 |
| 57 | H: APFF N52T & L: wt | S102A/S103P/S104F/H111F N52T | 203 | wildtype | 141 |
| 58 | H: APFF N52P & L: wt | S102A/S103P/S104F/H111F N52P | 204 | wildtype | 141 |
| 59 | H: APFF N52L & L: wt | S102A/S103P/S104F/H111F N52L | 205 | wildtype | 141 |
| 60 | H: APFF N52W & L: wt | S102A/S103P/S104F/H111F N52W | 206 | wildtype | 141 |
| 61 | H: APFF N52Y & L: wt | S102A/S103P/S104F/H111F N52Y | 207 | wildtype | 141 |
| 62 | H: APFF N52V & L: wt | S102A/S103P/S104F/H111F N52V | 208 | wildtype | 141 |
| 63 | H: APFF N52S & L: wt | S102A/S103P/S104F/H111F N52S | 209 | wildtype | 141 |
| 64 | H: APFF N52Q & L: wt | S102A/S103P/S104F/H111F N52Q | 210 | wildtype | 141 |
| 65 | H: APFF N52K & L: wt | S102A/S103P/S104F/H111F N52K | 211 | wildtype | 141 |
| 66 | H: APFF G56V & L: wt | S102A/S103P/S104F/H111F G56V | 212 | wildtype | 141 |
| 67 | H: APFF G56E & L: wt | S102A/S103P/S104F/H111F G56E | 213 | wildtype | 141 |
| 68 | H: APFF G56S & L: wt | S102A/S103P/S104F/H111F G56S | 214 | wildtype | 141 |
| 69 | H: APFF G56K & L: wt | S102A/S103P/S104F/H111F G56K | 215 | wildtype | 141 |
| 70 | H: APFF G56T & L: wt | S102A/S103P/S104F/H111F G56T | 216 | wildtype | 141 |
| 71 | H: APFF G56L & L: wt | S102A/S103P/S104F/H111F G56L | 217 | wildtype | 141 |
| 72 | H: APFF G56R & L: wt | S102A/S103P/S104F/H111F G56R | 218 | wildtype | 141 |
| 73 | H: APFF G56H & L: wt | S102A/S103P/S104F/H111F G56H | 219 | wildtype | 141 |
| 74 | H: APFF G56I & L: wt | S102A/S103P/S104F/H111F G56I | 220 | wildtype | 141 |
| 75 | H: APFF G56W & L: wt | S102A/S103P/S104F/H111F G56W | 221 | wildtype | 141 |
| 76 | H: APFF S54I & L: wt | S102A/S103P/S104F/H111F S54I | 222 | wildtype | 141 |
| 77 | H: APFF S54E & L: wt | S102A/S103P/S104F/H111F S54E | 223 | wildtype | 141 |
| 78 | H: APFF S54R & L: wt | S102A/S103P/S104F/H111F S54R | 224 | wildtype | 141 |
| 79 | H: APFF S54G & L: wt | S102A/S103P/S104F/H111F S54G | 225 | wildtype | 141 |
| 80 | H: APFF S54T & L: wt | S102A/S103P/S104F/H111F S54T | 226 | wildtype | 141 |
| 81 | H: APFF S54L & L: wt | S102A/S103P/S104F/H111F S54L | 227 | wildtype | 141 |
| 82 | H: APFF S54V & L: wt | S102A/S103P/S104F/H111F S54V | 228 | wildtype | 141 |
| 83 | H: APFF S54N & L: wt | S102A/S103P/S104F/H111F S54N | 229 | wildtype | 141 |
| 84 | H: APFF S54P & L: wt | S102A/S103P/S104F/H111F S54P | 230 | wildtype | 141 |
| 85 | H: APFF TP & L: wt | S102A/S103P/S104F/H111F I50T/S54P | 231 | wildtype | 141 |
| 86 | H: APFF AN & L: wt | S102A/S103P/S104F/H111F S54A/S59N | 232 | wildtype | 141 |
| 87 | H: APFF LTH & L: wt | S102A/S103P/S104F/H111F N52L/S54T/G56H | 233 | wildtype | 141 |
| 88 | H: APFF ALTH & L: wt | S102A/S103P/S104F/H111F I51A/N52L/S54T/G56H | 234 | wildtype | 141 |
| 89 | H: APFF TLTH & L: wt | S102A/S103P/S104F/H111F I51T/N52L/S54T/G56H | 235 | wildtype | 141 |
| 90 | H: APFF YLTH & L: wt | S102A/S103P/S104F/H111F I51Y/N52L/S54T/G56H | 236 | wildtype | 141 |
| 91 | H: APFF HLTH & L: wt | S102A/S103P/S104F/H111F I51H/N52L/S54T/G56H | 237 | wildtype | 141 |
| 92 | H: APFF ELTH & L: wt | S102A/S103P/S104F/H111F I51E/N52L/S54T/G56H | 238 | wildtype | 141 |
| 93 | H: APFF VLTH & L: wt | S102A/S103P/S104F/H111F I51V/N52L/S54T/G56H | 239 | wildtype | 141 |
| 94 | H: APFF GLTH & L: wt | S102A/S103P/S104F/H111F I51G/N52L/S54T/G56H | 240 | wildtype | 141 |
| 95 | H: APFF SLTH & L: wt | S102A/S103P/S104F/H111F I51S/N52L/S54T/G56H | 241 | wildtype | 141 |
| 96 | H: APFF WLTH & L: wt | S102A/S103P/S104F/H111F I51W/N52L/S54T/G56H | 242 | wildtype | 141 |
| 97 | H: APFF RLTH & L: wt | S102A/S103P/S104F/H111F I51R/N52L/S54T/G56H | 243 | wildtype | 141 |
| 98 | H: APFF NLTH & L: wt | S102A/S103P/S104F/H111F I51N/N52L/S54T/G56H | 244 | wildtype | 141 |
| 99 | H: APFF TLVTH & L: wt | S102A/S103P/S104F/H111F I51T/N52L/P53V/S54T/G56H | 245 | wildtype | 141 |
| 100 | H: APFF TLGTH & L: wt | S102A/S103P/S104F/H111F I51T/N52L/P53G/S54T/G56H | 246 | wildtype | 141 |
| 101 | H: APFF TLSTH & L: wt | S102A/S103P/S104F/H111F I51T/N52L/P53S/S54T/G56H | 247 | wildtype | 141 |
| 102 | H: APFF TLWTH & L: wt | S102A/S103P/S104F/H111F I51T/N52L/P53W/S54T/G56H | 248 | wildtype | 141 |
| 103 | H: APFF TLRTH & L: wt | S102A/S103P/S104F/H111F I51T/N52L/P53R/S54T/G56H | 249 | wildtype | 141 |
| 104 | H: APFF TLNTH & L: wt | S102A/S103P/S104F/H111F I51T/N52L/P53N/S54T/G56H | 250 | wildtype | 141 |
| 105 | H: APFF TLATH & L: wt | S102A/S103P/S104F/H111F I51T/N52L/P53A/S54T/G56H | 251 | wildtype | 141 |

TABLE 30-continued

VH1-46_IGHD6-6*01_IGHJ1*01 & L6_IGKJ1*01 DLL4 antibodies

| | Nickname | Heavy Chain VH1-46_IGHD6-6*01_IGHJ1*01 | SEQ ID NO | Light Chain L6_IGKJ1*01 | SEQ ID NO |
|---|---|---|---|---|---|
| 106 | H: APFF TLTTH & L: wt | S102A/S103P/S104F/H111F I51T/N52L/P53T/S54T/G56H | 252 | wildtype | 141 |
| 107 | H: APFF TLYTH & L: wt | S102A/S103P/S104F/H111F I51T/N52L/P53Y/S54T/G56H | 253 | wildtype | 141 |
| 108 | H: APFF TLHTH & L: wt | S102A/S103P/S104F/H111F I51T/N52L/P53H/S54T/G56H | 254 | wildtype | 141 |
| 109 | H: APFF TLETH & L: wt | S102A/S103P/S104F/H111F I51T/N52L/P53E/S54T/G56H | 255 | wildtype | 141 |
| 110 | H: APFF TLMTH & L: wt | S102A/S103P/S104F/H111F I51T/N52L/P53M/S54T/G56H | 256 | wildtype | 141 |
| 111 | H: APFF S84G & L: wt | S102A/S103P/S104F/H111F S84G | 257 | wildtype | 141 |
| 112 | H: APFF S84Q & L: wt | S102A/S103P/S104F/H111F S84Q | 258 | wildtype | 141 |
| 113 | H: APFF S84N & L: wt | S102A/S103P/S104F/H111F S84N | 259 | wildtype | 141 |
| 114 | H: APFF S84H & L: wt | S102A/S103P/S104F/H111F S84H | 260 | wildtype | 141 |
| 115 | H: APFF S84R & L: wt | S102A/S103P/S104F/H111F S84R | 261 | wildtype | 141 |
| 116 | H: APFF S84K & L: wt | S102A/S103P/S104F/H111F S84K | 262 | wildtype | 141 |
| 117 | H: APFF S84T & L: wt | S102A/S103P/S104F/H111F S84T | 263 | wildtype | 141 |
| 118 | H: APF & L: R91P | S102A/S103P/S104F | 155 | R91P | 267 |
| 119 | H: APF & L: R91L | S102A/S103P/S104F | 155 | R91L | 268 |
| 120 | H: APF & L: R91G | S102A/S103P/S104F | 155 | R91G | 269 |
| 121 | H: APF & L: R91Q | S102A/S103P/S104F | 155 | R91Q | 270 |
| 122 | H: APF & L: S92N | S102A/S103P/S104F | 155 | S92N | 271 |
| 123 | H: APF & L: S92C | S102A/S103P/S104F | 155 | S92C | 272 |
| 124 | H: APFF & L: N93Y | S102A/S103P/S104F/H111F | 156 | N93Y | 273 |
| 125 | H: APFF & L: N93S | S102A/S103P/S104F/H111F | 156 | N93S | 274 |
| 126 | H: APFF & L: N93H | S102A/S103P/S104F/H111F | 156 | N93H | 275 |
| 127 | H: APFF & L: N93Q | S102A/S103P/S104F/H111F | 156 | N93Q | 276 |
| 128 | H: APFF & L: W94R | S102A/S103P/S104F/H111F | 156 | W94R | 277 |
| 129 | H: APFF & L: W94S | S102A/S103P/S104F/H111F | 156 | W94S | 278 |
| 130 | H: APFF & L: W94T | S102A/S103P/S104F/H111F | 156 | W94T | 279 |
| 131 | H: APFF & L: W94L | S102A/S103P/S104F/H111F | 156 | W94L | 280 |
| 132 | H: APFF & L: W94P | S102A/S103P/S104F/H111F | 156 | W94P | 281 |
| 133 | H: APFF & L: W94M | S102A/S103P/S104F/H111F | 156 | W94M | 282 |
| 134 | H: APFF & L: S92P | S102A/S103P/S104F/H111F | 156 | S92P | 283 |
| 135 | H: APFF & L: S92A | S102A/S103P/S104F/H111F | 156 | S92A | 284 |
| 136 | H: APFF & L: S92Q | S102A/S103P/S104F/H111F | 156 | S92Q | 285 |
| 137 | H: APFF & L: S92V | S102A/S103P/S104F/H111F | 156 | S92V | 286 |
| 138 | H: APFF & L: S92T | S102A/S103P/S104F/H111F | 156 | S92T | 287 |
| 139 | H: APFF & L: S92C | S102A/S103P/S104F/H111F | 156 | S92C | 272 |
| 140 | H: APFF & L: S92R | S102A/S103P/S104F/H111F | 156 | S92R | 288 |
| 141 | H: APFF & L: S92G | S102A/S103P/S104F/H111F | 156 | S92G | 289 |
| 142 | H: APFF & L: S92V | S102A/S103P/S104F/H111F | 156 | S92V | 290 |
| 143 | H: APFF & L: S92M | S102A/S103P/S104F/H111F | 156 | S92M | 291 |
| 144 | H: APFF & L: S92N | S102A/S103P/S104F/H111F | 156 | S92N | 271 |
| 145 | H: APF & L: S30W | S102A/S103P/S104F | 155 | S30W | 292 |
| 146 | H: APF & L: S30R | S102A/S103P/S104F | 155 | S30R | 293 |
| 147 | H: APF & L: S30T | S102A/S103P/S104F | 155 | S30T | 294 |
| 148 | H: APF & L: S30L | S102A/S103P/S104F | 155 | S30L | 295 |
| 149 | H: APF & L: GL | S102A/S103P/S104F | 155 | R24G/Q27L | 296 |
| 150 | H: APF & L: Y32V | S102A/S103P/S104F | 155 | Y32V | 297 |
| 151 | H: APF & L: Y32S | S102A/S103P/S104F | 155 | Y32S | 298 |
| 152 | H: APFF & L: S28G | S102A/S103P/S104F/H111F | 156 | S28G | 299 |
| 153 | H: APFF & L: S28K | S102A/S103P/S104F/H111F | 156 | S28K | 300 |
| 154 | H: APFF & L: S28V | S102A/S103P/S104F/H111F | 156 | S28V | 301 |
| 155 | H: APFF & L: S28F | S102A/S103P/S104F/H111F | 156 | S28F | 302 |
| 156 | H: APFF & L: S28P | S102A/S103P/S104F/H111F | 156 | S28P | 264 |
| 157 | H: APFF & L: S28T | S102A/S103P/S104F/H111F | 156 | S28T | 303 |
| 158 | H: APFF & L: S28L | S102A/S103P/S104F/H111F | 156 | S28L | 304 |
| 159 | H: APFF & L: S28Q | S102A/S103P/S104F/H111F | 156 | S28Q | 305 |
| 160 | H: APFF & L: S28A | S102A/S103P/S104F/H111F | 156 | S28A | 306 |
| 161 | H: APFF & L: S28N | S102A/S103P/S104F/H111F | 156 | S28N | 307 |
| 162 | H: APFF & L: S28H | S102A/S103P/S104F/H111F | 156 | S28H | 308 |
| 163 | H: APFF & L: S28I | S102A/S103P/S104F/H111F | 156 | S28I | 309 |
| 164 | H: APFF & L: S28R | S102A/S103P/S104F/H111F | 156 | S28R | 310 |
| 165 | H: APFF & L: S28W | S102A/S103P/S104F/H111F | 156 | S28W | 311 |
| 166 | H: APFF & L: S28M | S102A/S103P/S104F/H111F | 156 | S28M | 312 |
| 167 | H: APFF & L: S28E | S102A/S103P/S104F/H111F | 156 | S28E | 313 |
| 168 | H: APFF & L: S30C | S102A/S103P/S104F/H111F | 156 | S30C | 314 |
| 169 | H: APFF & L: S30D | S102A/S103P/S104F/H111F | 156 | S30D | 315 |
| 170 | H: APFF & L: S30L | S102A/S103P/S104F/H111F | 156 | S30L | 316 |
| 171 | H: APFF & L: S30T | S102A/S103P/S104F/H111F | 156 | S30T | 317 |
| 172 | H: APFF & L: S30R | S102A/S103P/S104F/H111F | 156 | S30R | 318 |
| 173 | H: APFF & L: S30P | S102A/S103P/S104F/H111F | 156 | S30P | 319 |
| 174 | H: APFF & L: S30W | S102A/S103P/S104F/H111F | 156 | S30W | 320 |
| 175 | H: APFF & L: S30Y | S102A/S103P/S104F/H111F | 156 | S30Y | 321 |

TABLE 30-continued

VH1-46_IGHD6-6*01_IGHJ1*01 & L6_IGKJ1*01 DLL4 antibodies

| | Nickname | Heavy Chain VH1-46_IGHD6-6*01_IGHJ1*01 | SEQ ID NO | Light Chain L6_IGKJ1*01 | SEQ ID NO |
|---|---|---|---|---|---|
| 176 | H: APFF & L: S30Q | S102A/S103P/S104F/H111F | 156 | S30Q | 322 |
| 177 | H: APFF & L: S30A | S102A/S103P/S104F/H111F | 156 | S30A | 323 |
| 178 | H: APFF & L: S30G | S102A/S103P/S104F/H111F | 156 | S30G | 324 |
| 179 | H: APFF & L: S30N | S102A/S103P/S104F/H111F | 156 | S30N | 265 |
| 180 | H: APFF & L: S30V | S102A/S103P/S104F/H111F | 156 | S30V | 325 |
| 181 | H: APFF & L: S31T | S102A/S103P/S104F/H111F | 156 | S31T | 326 |
| 182 | H: APFF & L: S31N | S102A/S103P/S104F/H111F | 156 | S31N | 327 |
| 183 | H: APFF & L: S31K | S102A/S103P/S104F/H111F | 156 | S31K | 266 |
| 184 | H: APFF & L: S31L | S102A/S103P/S104F/H111F | 156 | S31L | 328 |
| 185 | H: APFF & L: S31M | S102A/S103P/S104F/H111F | 156 | S31M | 329 |
| 186 | H: APFF & L: S31F | S102A/S103P/S104F/H111F | 156 | S31F | 330 |
| 187 | H: APFF & L: S31I | S102A/S103P/S104F/H111F | 156 | S31I | 331 |
| 188 | H: APFF & L: S31V | S102A/S103P/S104F/H111F | 156 | S31V | 332 |
| 189 | H: APFF & L: S31H | S102A/S103P/S104F/H111F | 156 | S31H | 333 |
| 190 | H: APFF & L: S31A | S102A/S103P/S104F/H111F | 156 | S31A | 334 |
| 191 | H: APFF & L: S31P | S102A/S103P/S104F/H111F | 156 | S31P | 335 |
| 192 | H: APFF & L: S31D | S102A/S103P/S104F/H111F | 156 | S31D | 336 |
| 193 | H: APFF & L: S31R | S102A/S103P/S104F/H111F | 156 | S31R | 337 |
| 194 | H: APFF & L: S31Y | S102A/S103P/S104F/H111F | 156 | S31Y | 338 |
| 195 | H: APFF & L: S31Q | S102A/S103P/S104F/H111F | 156 | S31Q | 339 |
| 196 | H: APFF & L: S31E | S102A/S103P/S104F/H111F | 156 | S31E | 340 |
| 197 | H: APFF & L: S31G | S102A/S103P/S104F/H111F | 156 | S31G | 341 |
| 198 | H: APFF & L: PNK | S102A/S103P/S104F/H111F | 156 | S28P/S30N/S31K | 342 |
| 199 | H: APFF & L: NDH | S102A/S103P/S104F/H111F | 156 | S28N/S30D/S31H | 343 |
| 200 | H: APFF G56A & L: NDH | S102A/S103P/S104F/H111F G56A | 197 | S28N/S30D/S31H | 343 |
| 201 | H: APFF S54A & L: NDH | S102A/S103P/S104F/H111F S54A | 195 | S28N/S30D/S31H | 343 |
| 202 | H: APFF & L: | S102A/S103P/S104F/H111F | 156 | D50A | 344 |
| 203 | H: APFF & L: D50A | S102A/S103P/S104F/H111F | 156 | A51T | 345 |
| 204 | H: APFF & L: S52A | S102A/S103P/S104F/H111F | 156 | S52A | 346 |
| 205 | H: APFF & L: N53A | S102A/S103P/S104F/H111F | 156 | N53A | 347 |
| 206 | H: APFF & L: R54A | S102A/S103P/S104F/H111F | 156 | R54A | 348 |
| 207 | H: APFF & L: A55T | S102A/S103P/S104F/H111F | 156 | A55T | 349 |
| 208 | H: APFF & L: T56A | S102A/S103P/S104F/H111F | 156 | T56A | 350 |
| 209 | H: APFF & L: NDH S52L | S102A/S103P/S104F/H111F | 156 | S28N/S30D/S31H S52L | 351 |
| 210 | H: APFF & L: NDH S52T | S102A/S103P/S104F/H111F | 156 | S28N/S30D/S31H S52T | 352 |
| 211 | H: APFF & L: NDH S52R | S102A/S103P/S104F/H111F | 156 | S28N/S30D/S31H S52R | 353 |
| 212 | H: APFF & L: NDH S52W | S102A/S103P/S104F/H111F | 156 | S28N/S30D/S31H S52W | 354 |
| 213 | H: APFF & L: NDH S52N | S102A/S103P/S104F/H111F | 156 | S28N/S30D/S31H S52N | 355 |
| 214 | H: APFF & L: NDH S52P | S102A/S103P/S104F/H111F | 156 | S28N/S30D/S31H S52P | 356 |
| 215 | H: APFF & L: NDH S52M | S102A/S103P/S104F/H111F | 156 | S28N/S30D/S31H S52M | 357 |
| 216 | H: APFF & L: NDH N53E | S102A/S103P/S104F/H111F | 156 | S28N/S30D/S31H N53E | 358 |
| 217 | H: APFF & L: NDH N53G | S102A/S103P/S104F/H111F | 156 | S28N/S30D/S31H N53G | 359 |
| 218 | H: APFF & L: NDH N53M | S102A/S103P/S104F/H111F | 156 | S28N/S30D/S31H N53M | 360 |
| 219 | H: APFF & L: NDH N53C | S102A/S103P/S104F/H111F | 156 | S28N/S30D/S31H N53C | 361 |
| 220 | H: APFF & L: NDH N53H | S102A/S103P/S104F/H111F | 156 | S28N/S30D/S31H N53H | 362 |
| 221 | H: APFF & L: NDH N53P | S102A/S103P/S104F/H111F | 156 | S28N/S30D/S31H N53P | 363 |
| 222 | H: APFF & L: NDH N53A | S102A/S103P/S104F/H111F | 156 | S28N/S30D/S31H N53A | 364 |
| 223 | H: APFF & L: NDH A55R | S102A/S103P/S104F/H111F | 156 | S28N/S30D/S31H A55R | 365 |
| 224 | H: APFF & L: NDH A55C | S102A/S103P/S104F/H111F | 156 | S28N/S30D/S31H A55C | 366 |
| 225 | H: APFF & L: NDH A55S | S102A/S103P/S104F/H111F | 156 | S28N/S30D/S31H A55S | 367 |
| 226 | H: APFF & L: NDH A55G | S102A/S103P/S104F/H111F | 156 | S28N/S30D/S31H A55G | 368 |
| 227 | H: APFF LTH & L: NDH | S102A/S103P/S104F/H111F N52L/S54T/G56H | 156 | S28N/S30D/S31H | 343 |
| 228 | H: APFF LTH & L: NDH LG | S102A/S103P/S104F/H111F N52L/S54T/G56H | 156 | S28N/S30D/S31H S52L/A55G | 369 |
| 229 | H: APFF LTH & L: NDH LS | S102A/S103P/S104F/H111F N52L/S54T/G56H | 156 | S28N/S30D/S31H S52L/A55S | 370 |
| 230 | H: APFF ALTH & L: NDH | S102A/S103P/S104F/H111F I51A/N52L/S54T/G56H | 156 | S28N/S30D/S31H | 343 |
| 231 | H: APFF ALTH & L: NDH LG | S102A/S103P/S104F/H111F I51A/N52L/S54T/G56H | 156 | S28N/S30D/S31H S52L/A55G | 369 |
| 232 | H: APFF ALTH & L: NDH LS | S102A/S103P/S104F/H111F I51A/N52L/S54T/G56H | 156 | S28N/S30D/S31H S52L/A55S | 370 |
| 233 | H: APFF VLTH & L: NDH | S102A/S103P/S104F/H111F I51V/N52L/S54T/G56H | 156 | S28N/S30D/S31H | 343 |
| 234 | H: APFF VLTH & L: NDH LG | S102A/S103P/S104F/H111F I51V/N52L/S54T/G56H | 156 | S28N/S30D/S31H S52L/A55G | 369 |
| 235 | H: APFF VLTH & L: NDH LS | S102A/S103P/S104F/H111F I51V/N52L/S54T/G56H | 156 | S28N/S30D/S31H S52L/A55S | 370 |
| 236 | H: APFF & L: S76L | S102A/S103P/S104F/H111F | 156 | S76L | 371 |
| 237 | H: APFF & L: S76T | S102A/S103P/S104F/H111F | 156 | S76T | 372 |
| 238 | H: APFF & L: S76G | S102A/S103P/S104F/H111F | 156 | S76G | 373 |
| 239 | H: APFF & L: S76A | S102A/S103P/S104F/H111F | 156 | S76A | 374 |
| 240 | H: APFF & L: S76Y | S102A/S103P/S104F/H111F | 156 | S76Y | 375 |
| 241 | H: APFF & L: F62L | S102A/S103P/S104F/H111F | 156 | F62L | 376 |

TABLE 30-continued

VH1-46__IGHD6-6*01__IGHJ1*01 & L6__IGKJ1*01 DLL4 antibodies

| | Nickname | Heavy Chain VH1-46__IGHD6-6*01__IGHJ1*01 | SEQ ID NO | Light Chain L6__IGKJ1*01 | SEQ ID NO |
|---|---|---|---|---|---|
| 242 | H: APFF & L: S76E | S102A/S103P/S104F/H111F | 156 | S76E | 377 |
| 243 | H: APFF & L: S76Q | S102A/S103P/S104F/H111F | 156 | S76Q | 378 |
| 244 | H: APFF & L: S76P | S102A/S103P/S104F/H111F | 156 | S76P | 379 |
| 245 | H: APFF & L: S76N | S102A/S103P/S104F/H111F | 156 | S76N | 380 |

TABLE 31

VH5-51__IGHD5-18*01 > 3__IGHJ4*01 & V3-4__IGLJ1*01 DLL4 antibodies

| | nickname | Heavy Chain | SEQ ID NO | Light Chain | SEQ ID NO |
|---|---|---|---|---|---|
| 1 | wildtype | wildtype | 132 | wildtype | 142 |
| 2 | H: G100K & L: wt | G100K | 381 | wildtype | 142 |
| 3 | H: G100R & L: wt | G100R | 382 | wildtype | 142 |
| 4 | H: G104T & L: wt | G104T | 383 | wildtype | 142 |
| 5 | H: KT & L: wt | G100K/G104T | 384 | wildtype | 142 |
| 6 | H: R99A & L: wt | R99A | 385 | wildtype | 142 |
| 7 | H: G100A & L: wt | G100A | 386 | wildtype | 142 |
| 8 | H: Y101A & L: wt | Y101A | 387 | wildtype | 142 |
| 9 | H: S102A & L: wt | S102A | 388 | wildtype | 142 |
| 10 | H: Y103A & L: wt | Y103A | 389 | wildtype | 142 |
| 11 | H: G104A & L: wt | G104A | 390 | wildtype | 142 |
| 12 | H: Y105A & L: wt | Y105A | 391 | wildtype | 142 |
| 13 | H: D106A & L: wt | D106A | 392 | wildtype | 142 |
| 14 | H: G100L & L: wt | G100L | 393 | wildtype | 142 |
| 15 | H: G100D & L: wt | G100D | 394 | wildtype | 142 |
| 16 | H: G100T & L: wt | G100T | 395 | wildtype | 142 |
| 17 | H: G104D & L: wt | G104D | 396 | wildtype | 142 |
| 18 | H: G104L & L: wt | G104L | 397 | wildtype | 142 |
| 19 | H: G104P & L: wt | G104P | 398 | wildtype | 142 |
| 20 | H: G104R & L: wt | G104R | 399 | wildtype | 142 |
| 21 | H: G104M & L: wt | G104M | 400 | wildtype | 142 |
| 22 | H: G104K & L: wt | G104K | 401 | wildtype | 142 |
| 23 | H: G104S & L: wt | G104S | 402 | wildtype | 142 |
| 24 | H: RY & L: wt | G104R/Y101H | 403 | wildtype | 142 |
| 25 | H: KT G24A & L: wt | G100K/G104T G24A | 404 | wildtype | 142 |
| 26 | H: KT I34A & L: wt | G100K/G104T I34A | 405 | wildtype | 142 |
| 27 | H: KT G35A & L: wt | G100K/G104T G35A | 406 | wildtype | 142 |
| 28 | H: KT S28A & L: wt | G100K/G104T S28A | 407 | wildtype | 142 |
| 29 | H: KT F29A & L: wt | G100K/G104T F29A | 408 | wildtype | 142 |
| 30 | H: KT T30A & L: wt | G100K/G104T T30A | 409 | wildtype | 142 |
| 31 | H: KT W33A & L: wt | G100K/G104T W33A | 410 | wildtype | 142 |
| 32 | H: KT G24L & L: wt | G100K/G104T G24L | 411 | wildtype | 142 |
| 33 | H: KT G24S & L: wt | G100K/G104T G24S | 412 | wildtype | 142 |
| 34 | H: KT G24R & L: wt | G100K/G104T G24R | 413 | wildtype | 142 |
| 35 | H: KT S28R & L: wt | G100K/G104T S28R | 414 | wildtype | 142 |
| 36 | H: KT S28K & L: wt | G100K/G104T S28K | 415 | wildtype | 142 |
| 37 | H: KT S28N & L: wt | G100K/G104T S28N | 416 | wildtype | 142 |
| 38 | H: KT G35T & L: wt | G100K/G104T G35T | 417 | wildtype | 142 |
| 39 | H: KT G35A & L: wt | G100K/G104T G35A | 418 | wildtype | 142 |
| 40 | H: KT G35V & L: wt | G100K/G104T G35V | 419 | wildtype | 142 |
| 41 | H: KT Y27A & L: wt | G100K/G104T Y27A | 894 | wildtype | 142 |
| 42 | H: KT S31A & L: wt | G100K/G104T S31A | 895 | wildtype | 142 |
| 43 | H: KT S31A & L: wt | G100K/G104T Y32A | 896 | wildtype | 142 |
| 44 | H: KT LRV & L: wt | G100K/G104T G24L/S28R/G35V | 420 | wildtype | 142 |
| 45 | H: KT D57A & L: wt | G100K/G104T D57A | 421 | wildtype | 142 |
| 46 | H: KT I50A & L: wt | G100K/G104T I50A | 422 | wildtype | 142 |
| 47 | H: KT I51A & L: wt | G100K/G104T I51A | 423 | wildtype | 142 |
| 48 | H: KT Y52A & L: wt | G100K/G104T Y52A | 424 | wildtype | 142 |
| 49 | H: KT P53A & L: wt | G100K/G104T P53A | 425 | wildtype | 142 |
| 50 | H: KT D55A & L: wt | G100K/G104T D55A | 426 | wildtype | 142 |
| 51 | H: KT T58D & L: wt | G100K/G104T T58D | 427 | wildtype | 142 |
| 52 | H: KT T58A & L: wt | G100K/G104T T58A | 428 | wildtype | 142 |
| 53 | H: KT S56G & L: wt | G100K/G104T S56G | 429 | wildtype | 142 |
| 54 | H: KT S84V & L: wt | G100K/G104T S84V | 430 | wildtype | 142 |
| 55 | H: KT G54A & L: wt | G100K/G104T G54A | 897 | wildtype | 142 |
| 56 | H: KT S56A & L: wt | G100K/G104T S56A | 898 | wildtype | 142 |
| 57 | H: KT S84L & L: wt | G100K/G104T S84L | 431 | wildtype | 142 |
| 58 | H: KT D109A & L: wt | G100K/G104T D109A | 432 | wildtype | 142 |
| 59 | H: KT & L: V91A | G100K/G104T | 384 | V91A | 439 |
| 60 | H: KT & L: L92A | G100K/G104T | 384 | L92A | 440 |

TABLE 31-continued

VH5-51_IGHD5-18*01 > 3_IGHJ4*01 & V3-4_IGLJ1*01 DLL4 antibodies

| | nickname | Heavy Chain | SEQ ID NO | Light Chain | SEQ ID NO |
|---|---|---|---|---|---|
| 61 | H: KT & L: Y93A | G100K/G104T | 384 | Y93A | 441 |
| 62 | H: KT & L: M94A | G100K/G104T | 384 | M94A | 442 |
| 63 | H: KT & L: G95A | G100K/G104T | 384 | G95A | 443 |
| 64 | H: KT & L: G97A | G100K/G104T | 384 | G97A | 444 |
| 65 | H: KT & L: S96A | G100K/G104T | 384 | S96A | 445 |
| 66 | H: KT & L: I98A | G100K/G104T | 384 | I98A | 446 |
| 67 | H: KT & L: S99A | G100K/G104T | 384 | S99A | 447 |
| 68 | H: KT & L: V91P | G100K/G104T | 384 | V91P | 448 |
| 69 | H: KT & L: V91T | G100K/G104T | 384 | V91T | 449 |
| 70 | H: KT & L: V91S | G100K/G104T | 384 | V91S | 450 |
| 71 | H: KT & L: V91L | G100K/G104T | 384 | V91L | 451 |
| 72 | H: KT & L: V91R | G100K/G104T | 384 | V91R | 452 |
| 73 | H: KT & L: V91C | G100K/G104T | 384 | V91C | 453 |
| 74 | H: KT & L: V91E | G100K/G104T | 384 | V91E | 454 |
| 75 | H: KT & L: V91W | G100K/G104T | 384 | V91W | 455 |
| 76 | H: KT & L: V91N | G100K/G104T | 384 | V91N | 456 |
| 77 | H: KT & L: V91I | G100K/G104T | 384 | V91I | 457 |
| 78 | H: KT & L: V91G | G100K/G104T | 384 | V91G | 458 |
| 79 | H: KT & L: V91H | G100K/G104T | 384 | V91H | 459 |
| 80 | H: KT & L: M94E | G100K/G104T | 384 | M94E | 460 |
| 81 | H: KT & L: M94S | G100K/G104T | 384 | M94S | 461 |
| 82 | H: KT & L: M94G | G100K/G104T | 384 | M94G | 462 |
| 83 | H: KT & L: M94L | G100K/G104T | 384 | M94L | 463 |
| 84 | H: KT & L: M94P | G100K/G104T | 384 | M94P | 464 |
| 85 | H: KT & L: M94V | G100K/G104T | 384 | M94V | 465 |
| 86 | H: KT & L: M94D | G100K/G104T | 384 | M94D | 466 |
| 87 | H: KT & L: M94R | G100K/G104T | 384 | M94R | 467 |
| 88 | H: KT & L: M94N | G100K/G104T | 384 | M94N | 468 |
| 89 | H: KT & L: M94T | G100K/G104T | 384 | M94T | 469 |
| 90 | H: KT & L: M94F | G100K/G104T | 384 | M94F | 470 |
| 91 | H: KT & L: S96W | G100K/G104T | 384 | S96W | 471 |
| 92 | H: KT & L: S96G | G100K/G104T | 384 | S96G | 472 |
| 93 | H: KT & L: S96P | G100K/G104T | 384 | S96P | 473 |
| 94 | H: KT & L: S96R | G100K/G104T | 384 | S96R | 474 |
| 95 | H: KT & L: S96L | G100K/G104T | 384 | S96L | 475 |
| 96 | H: KT & L: S96M | G100K/G104T | 384 | S96M | 476 |
| 97 | H: KT & L: S96E | G100K/G104T | 384 | S96E | 477 |
| 98 | H: KT & L: S96V | G100K/G104T | 384 | S96V | 478 |
| 99 | H: KT & L: RM | G100K/G104T | 384 | M94R/S96M | 479 |
| 100 | H: KT S28R & L: RM | G100K/G104T S28R | 414 | M94R/S96M | 479 |
| 101 | H: KT LRV & L: RM | G100K/G104T G24L/S28R/G35V | 420 | M94R/S96M | 479 |
| 102 | H: KT TRV & L: RM | G100K/G104T G24T/S28R/G35V | 433 | M94R/S96M | 479 |
| 103 | H: KT ARV & L: RM | G100K/G104T G24A/S28R/G35V | 434 | M94R/S96M | 479 |
| 104 | H: KT TRV & L: wt | G100K/G104T G24T/S28R/G35V | 433 | wildtype | 142 |
| 105 | H: KT ARV & L: wt | G100K/G104T G24A/S28R/G35V | 434 | wildtype | 142 |
| 106 | H: KT & L: L24A | G100K/G104T | 385 | L24A | 480 |
| 107 | H: KT & L: S26A | G100K/G104T | 385 | S26A | 481 |
| 108 | H: KT & L: G27A | G100K/G104T | 385 | G27A | 482 |
| 109 | H: KT & L: S28A | G100K/G104T | 385 | S28A | 483 |
| 110 | H: KT & L: V29A | G100K/G104T | 385 | V29A | 484 |
| 111 | H: KT & L: S30A | G100K/G104T | 385 | S30A | 485 |
| 112 | H: KT & L: T31A | G100K/G104T | 385 | T31A | 486 |
| 113 | H: KT & L: S32A | G100K/G104T | 385 | S32A | 487 |
| 114 | H: KT & L: Y33A | G100K/G104T | 385 | Y33A | 488 |
| 115 | H: KT & L: Y34A | G100K/G104T | 385 | Y34A | 489 |
| 116 | H: KT & L: P35A | G100K/G104T | 385 | P35A | 490 |
| 117 | H: KT & L: S36A | G100K/G104T | 385 | S36A | 491 |
| 118 | H: KT & L: G23A | G100K/G104T | 385 | G23A | 492 |
| 119 | H: KT & L: S25A | G100K/G104T | 385 | S25A | 493 |
| 120 | H: KT & L: G23R | G100K/G104T | 385 | G23R | 494 |
| 121 | H: KT & L: G23L | G100K/G104T | 385 | G23L | 495 |
| 122 | H: KT & L: S52A | G100K/G104T | 385 | S52A | 496 |
| 123 | H: KT & L: T53A | G100K/G104T | 385 | T53A | 497 |
| 124 | H: KT & L: N54A | G100K/G104T | 385 | N54A | 498 |
| 125 | H: KT & L: T55A | G100K/G104T | 385 | T55A | 499 |
| 126 | H: KT & L: R56A | G100K/G104T | 385 | R56A | 500 |
| 127 | H: KT & L: S57A | G100K/G104T | 385 | S57A | 501 |
| 128 | H: KT & L: S58A | G100K/G104T | 385 | S58A | 502 |
| 129 | H: KT & L: S52G | G100K/G104T | 385 | S52G | 503 |
| 130 | H: KT & L: S52C | G100K/G104T | 385 | S52C | 504 |
| 131 | H: KT & L: S52R | G100K/G104T | 385 | S52R | 505 |
| 132 | H: KT & L: R56I | G100K/G104T | 385 | R56I | 506 |
| 133 | H: KT & L: R56Y | G100K/G104T | 385 | R56Y | 507 |
| 134 | H: KT & L: R56D | G100K/G104T | 385 | R56D | 508 |
| 135 | H: KT & L: R56G | G100K/G104T | 385 | R56G | 509 |

TABLE 31-continued

VH5-51_IGHD5-18*01 > 3_IGHJ4*01 & V3-4_IGLJ1*01 DLL4 antibodies

| | nickname | Heavy Chain | SEQ ID NO | Light Chain | SEQ ID NO |
|---|---|---|---|---|---|
| 136 | H: KT & L: R56S | G100K/G104T | 385 | R56S | 510 |
| 137 | H: KT & L: T78S | G100K/G104T | 385 | T78S | 511 |
| 138 | H: KT & L: T78E | G100K/G104T | 385 | T78E | 512 |
| 139 | H: KT & L: T78Y | G100K/G104T | 385 | T78Y | 513 |
| 140 | H: KT & L: T78M | G100K/G104T | 385 | T78M | 514 |
| 141 | H: KT & L: T78L | G100K/G104T | 385 | T78L | 515 |
| 142 | H: KT & L: T78K | G100K/G104T | 385 | T78K | 516 |
| 143 | H: KT & L: T78V | G100K/G104T | 385 | T78V | 517 |
| 144 | H: KT & L: AK | G100K/G104T | 385 | G23A/N175K | 518 |
| 145 | H: KT & L: AT | G100K/G104T | 385 | S25A/A116T | 519 |
| 146 | H: KT TRV & L: V91A | G100K/G104T G24T/S28R/G35V | 433 | V91A | 439 |
| 147 | H: KT TRV & L: L92A | G100K/G104T G24T/S28R/G35V | 433 | L92A | 440 |
| 148 | H: KT TRV & L: Y93A | G100K/G104T G24T/S28R/G35V | 433 | Y93A | 441 |
| 149 | H: KT TRV & L: M94A | G100K/G104T G24T/S28R/G35V | 433 | M94A | 442 |
| 150 | H: KT TRV & L: G95A | G100K/G104T G24T/S28R/G35V | 433 | G95A | 443 |
| 151 | H: KT TRV & L: S96A | G100K/G104T G24T/S28R/G35V | 433 | S96A | 444 |
| 152 | H: KT TRV & L: G67A | G100K/G104T G24T/S28R/G35V | 433 | G97A | 445 |
| 153 | H: KT TRV & L: I98A | G100K/G104T G24T/S28R/G35V | 433 | I98A | 446 |
| 154 | H: KT TRV & L: S99A | G100K/G104T G24T/S28R/G35V | 433 | S99A | 447 |
| 155 | H: KT TRV & L: T78S | G100K/G104T G24T/S28R/G35V | 433 | T78S | 511 |
| 156 | H: KT TRV & L: T78E | G100K/G104T G24T/S28R/G35V | 433 | T78E | 512 |
| 157 | H: KT TRV & L: T78L | G100K/G104T G24T/S28R/G35V | 433 | T78L | 515 |
| 158 | H: KT TRV & L: T78K | G100K/G104T G24T/S28R/G35V | 433 | T78K | 516 |
| 159 | H: KT TRV & L: T78V | G100K/G104T G24T/S28R/G35V | 433 | T78V | 517 |
| 160 | H: KT TRV & L: G23A | G100K/G104T G24T/S28R/G35V | 433 | G23A | 492 |
| 161 | H: KT TRV & L: L24A | G100K/G104T G24T/S28R/G35V | 433 | L24A | 480 |
| 162 | H: KT TRV & L: S25A | G100K/G104T G24T/S28R/G35V | 433 | S25A | 493 |
| 163 | H: KT TRV & L: S26A | G100K/G104T G24T/S28R/G35V | 433 | S26A | 481 |
| 164 | H: KT TRV & L: G27A | G100K/G104T G24T/S28R/G35V | 433 | G27A | 482 |
| 165 | H: KT TRV & L: S28A | G100K/G104T G24T/S28R/G35V | 433 | S28A | 483 |
| 166 | H: KT TRV & L: V29A | G100K/G104T G24T/S28R/G35V | 433 | V29A | 484 |
| 167 | H: KT TRV & L: S30A | G100K/G104T G24T/S28R/G35V | 433 | S30A | 485 |
| 168 | H: KT TRV & L: T31A | G100K/G104T G24T/S28R/G35V | 433 | T31A | 486 |
| 169 | H: KT TRV & L: S32A | G100K/G104T G24T/S28R/G35V | 433 | S32A | 487 |
| 170 | H: KT TRV & L: Y33A | G100K/G104T G24T/S28R/G35V | 433 | Y33A | 488 |
| 171 | H: KT TRV & L: Y34A | G100K/G104T G24T/S28R/G35V | 433 | Y34A | 489 |
| 172 | H: KT TRV & L: P35A | G100K/G104T G24T/S28R/G35V | 433 | P35A | 490 |
| 173 | H: KT TRV & L: S36A | G100K/G104T G24T/S28R/G35V | 433 | S36A | 491 |
| 174 | H: KT TRV & L: S52A | G100K/G104T G24T/S28R/G35V | 433 | S52A | 496 |
| 175 | H: KT TRV & L: T53A | G100K/G104T G24T/S28R/G35V | 433 | T53A | 497 |
| 176 | H: KT TRV & L: N54A | G100K/G104T G24T/S28R/G35V | 433 | N54A | 498 |
| 177 | H: KT TRV & L: T55A | G100K/G104T G24T/S28R/G35V | 433 | T55A | 499 |
| 178 | H: KT TRV & L: R56A | G100K/G104T G24T/S28R/G35V | 433 | R56A | 500 |
| 179 | H: KT TRV & L: S57A | G100K/G104T G24T/S28R/G35V | 433 | S57A | 501 |
| 180 | H: KT TRV & L: S58A | G100K/G104T G24T/S28R/G35V | 433 | S58A | 502 |
| 181 | H: KT TRV & L: V91L | G100K/G104T G24T/S28R/G35V | 433 | V91L | 451 |
| 182 | H: KT TRV & L: V91P | G100K/G104T G24T/S28R/G35V | 433 | V91P | 447 |
| 183 | H: KT TRV & L: V91T | G100K/G104T G24T/S28R/G35V | 433 | V91T | 449 |
| 184 | H: KT TRV & L: V91S | G100K/G104T G24T/S28R/G35V | 433 | V91S | 450 |
| 185 | H: KT TRV & L: V91R | G100K/G104T G24T/S28R/G35V | 433 | V91R | 452 |
| 186 | H: KT TRV & L: V91C | G100K/G104T G24T/S28R/G35V | 433 | V91C | 453 |
| 187 | H: KT TRV & L: V91E | G100K/G104T G24T/S28R/G35V | 433 | V91E | 454 |
| 188 | H: KT TRV & L: V91W | G100K/G104T G24T/S28R/G35V | 433 | V91W | 455 |
| 189 | H: KT TRV & L: V91N | G100K/G104T G24T/S28R/G35V | 433 | V91N | 456 |
| 190 | H: KT TRV & L: V91I | G100K/G104T G24T/S28R/G35V | 433 | V91I | 457 |
| 191 | H: KT TRV & L: V91G | G100K/G104T G24T/S28R/G35V | 433 | V91G | 458 |
| 192 | H: KT TRV & L: V91H | G100K/G104T G24T/S28R/G35V | 433 | V91H | 459 |
| 193 | H: KT TRV & L: M94T | G100K/G104T G24T/S28R/G35V | 433 | M94T | 469 |
| 194 | H: KT TRV & L: M94E | G100K/G104T G24T/S28R/G35V | 433 | M94E | 460 |
| 195 | H: KT TRV & L: M94S | G100K/G104T G24T/S28R/G35V | 433 | M94S | 461 |
| 196 | H: KT TRV & L: M94G | G100K/G104T G24T/S28R/G35V | 433 | M94G | 462 |
| 197 | H: KT TRV & L: M94L | G100K/G104T G24T/S28R/G35V | 433 | M94L | 463 |
| 198 | H: KT TRV & L: M94P | G100K/G104T G24T/S28R/G35V | 433 | M94P | 464 |
| 199 | H: KT TRV & L: M94V | G100K/G104T G24T/S28R/G35V | 433 | M94V | 465 |
| 200 | H: KT TRV & L: M94D | G100K/G104T G24T/S28R/G35V | 433 | M94D | 466 |
| 201 | H: KT TRV & L: M94R | G100K/G104T G24T/S28R/G35V | 433 | M94R | 467 |
| 202 | H: KT TRV & L: M94N | G100K/G104T G24T/S28R/G35V | 433 | M94N | 468 |
| 203 | H: KT TRV & L: M94F | G100K/G104T G24T/S28R/G35V | 433 | M94F | 470 |
| 204 | H: KT TRV & L: S96W | G100K/G104T G24T/S28R/G35V | 433 | S96W | 471 |
| 205 | H: KT TRV & L: S96G | G100K/G104T G24T/S28R/G35V | 433 | S96G | 472 |
| 206 | H: KT TRV & L: S96P | G100K/G104T G24T/S28R/G35V | 433 | S96P | 473 |
| 207 | H: KT TRV & L: S96R | G100K/G104T G24T/S28R/G35V | 433 | S96R | 474 |
| 208 | H: KT TRV & L: S96L | G100K/G104T G24T/S28R/G35V | 433 | S96L | 475 |
| 209 | H: KT TRV & L: S96M | G100K/G104T G24T/S28R/G35V | 433 | S96M | 476 |
| 210 | H: KT TRV & L: S96E | G100K/G104T G24T/S28R/G35V | 433 | S96E | 477 |

TABLE 31-continued

VH5-51_IGHD5-18*01 > 3_IGHJ4*01 & V3-4_IGLJ1*01 DLL4 antibodies

| | nickname | Heavy Chain | SEQ ID NO | Light Chain | SEQ ID NO |
|---|---|---|---|---|---|
| 211 | H: KT TRV & L: S96V | G100K/G104T G24T/S28R/G35V | 433 | S96V | 478 |
| 212 | H: KT TRV & L: LP S52F | G100K/G104T G24T/S28R/G35V | 433 | V91L/S96P S52F | 520 |
| 213 | H: KT TRV & L: LP S52L | G100K/G104T G24T/S28R/G35V | 433 | V91L/S96P S52L | 521 |
| 214 | H: KT TRV & L: LP S52I | G100K/G104T G24T/S28R/G35V | 433 | V91L/S96P S52I | 522 |
| 215 | H: KT TRV & L: LP S52M | G100K/G104T G24T/S28R/G35V | 433 | V91L/S96P S52M | 523 |
| 216 | H: KT TRV & L: LP S52V | G100K/G104T G24T/S28R/G35V | 433 | V91L/S96P S52V | 524 |
| 217 | H: KT TRV & L: LP S52P | G100K/G104T G24T/S28R/G35V | 433 | V91L/S96P S52P | 525 |
| 218 | H: KT TRV & L: LP S52T | G100K/G104T G24T/S28R/G35V | 433 | V91L/S96P S52T | 526 |
| 219 | H: KT TRV & L: LP S52Y | G100K/G104T G24T/S28R/G35V | 433 | V91L/S96P S52Y | 527 |
| 220 | H: KT TRV & L: LP S52H | G100K/G104T G24T/S28R/G35V | 433 | V91L/S96P S52H | 528 |
| 221 | H: KT TRV & L: LP S52Q | G100K/G104T G24T/S28R/G35V | 433 | V91L/S96P S52Q | 529 |
| 222 | H: KT TRV & L: LP S52N | G100K/G104T G24T/S28R/G35V | 433 | V91L/S96P S52N | 530 |
| 223 | H: KT TRV & L: LP S52K | G100K/G104T G24T/S28R/G35V | 433 | V91L/S96P S52K | 531 |
| 224 | H: KT TRV & L: LP S52D | G100K/G104T G24T/S28R/G35V | 433 | V91L/S96P S52D | 532 |
| 225 | H: KT TRV & L: LP S52E | G100K/G104T G24T/S28R/G35V | 433 | V91L/S96P S52E | 533 |
| 226 | H: KT TRV & L: LP S52W | G100K/G104T G24T/S28R/G35V | 433 | V91L/S96P S52W | 534 |
| 227 | H: KT TRV & L: LP S52R | G100K/G104T G24T/S28R/G35V | 433 | V91L/S96P S52R | 535 |
| 228 | H: KT TRV & L: LP S52G | G100K/G104T G24T/S28R/G35V | 433 | V91L/S96P S52G | 536 |
| 229 | H: KT TRV & L: LP | G100K/G104T G24T/S28R/G35V | 433 | V91L/S96P | 537 |
| 230 | H: KT TRV & L: LP T53F | G100K/G104T G24T/S28R/G35V | 433 | V91L/S96P T53F | 538 |
| 231 | H: KT TRV & L: LP T53L | G100K/G104T G24T/S28R/G35V | 433 | V91L/S96P T53L | 539 |
| 232 | H: KT TRV & L: LP T53I | G100K/G104T G24T/S28R/G35V | 433 | V91L/S96P T53I | 540 |
| 233 | H: KT TRV & L: LP T53M | G100K/G104T G24T/S28R/G35V | 433 | V91L/S96P T53M | 541 |
| 234 | H: KT TRV & L: LP T53V | G100K/G104T G24T/S28R/G35V | 433 | V91L/S96P T53V | 542 |
| 235 | H: KT TRV & L: LP T53S | G100K/G104T G24T/S28R/G35V | 433 | V91L/S96P T53S | 543 |
| 236 | H: KT TRV & L: LP T53P | G100K/G104T G24T/S28R/G35V | 433 | V91L/S96P T53P | 544 |
| 237 | H: KT TRV & L: LP T53Y | G100K/G104T G24T/S28R/G35V | 433 | V91L/S96P T53Y | 545 |
| 238 | H: KT TRV & L: LP T53H | G100K/G104T G24T/S28R/G35V | 433 | V91L/S96P T53H | 546 |
| 239 | H: KT TRV & L: LP T53Q | G100K/G104T G24T/S28R/G35V | 433 | V91L/S96P T53Q | 547 |
| 240 | H: KT TRV & L: LP T53N | G100K/G104T G24T/S28R/G35V | 433 | V91L/S96P T53N | 548 |
| 241 | H: KT TRV & L: LP T53K | G100K/G104T G24T/S28R/G35V | 433 | V91L/S96P T53K | 549 |
| 242 | H: KT TRV & L: LP T53D | G100K/G104T G24T/S28R/G35V | 433 | V91L/S96P T53D | 550 |
| 243 | H: KT TRV & L: LP T53E | G100K/G104T G24T/S28R/G35V | 433 | V91L/S96P T53E | 551 |
| 244 | H: KT TRV & L: LP T53W | G100K/G104T G24T/S28R/G35V | 433 | V91L/S96P T53W | 552 |
| 245 | H: KT TRV & L: LP T53R | G100K/G104T G24T/S28R/G35V | 433 | V91L/S96P T53R | 553 |
| 246 | H: KT TRV & L: LP T53G | G100K/G104T G24T/S28R/G35V | 433 | V91L/S96P T53G | 554 |
| 247 | H: KT TRV & L: LP S57F | G100K/G104T G24T/S28R/G35V | 433 | V91L/S96P S57F | 555 |
| 248 | H: KT TRV & L: LP S57L | G100K/G104T G24T/S28R/G35V | 433 | V91L/S96P S57L | 556 |
| 249 | H: KT TRV & L: LP S57I | G100K/G104T G24T/S28R/G35V | 433 | V91L/S96P S57I | 557 |
| 250 | H: KT TRV & L: LP S57M | G100K/G104T G24T/S28R/G35V | 433 | V91L/S96P S57M | 558 |
| 251 | H: KT TRV & L: LP S57V | G100K/G104T G24T/S28R/G35V | 433 | V91L/S96P S57V | 559 |
| 252 | H: KT TRV & L: LP S57P | G100K/G104T G24T/S28R/G35V | 433 | V91L/S96P S57P | 560 |
| 253 | H: KT TRV & L: LP S57T | G100K/G104T G24T/S28R/G35V | 433 | V91L/S96P S57T | 561 |
| 254 | H: KT TRV & L: LP S57Y | G100K/G104T G24T/S28R/G35V | 433 | V91L/S96P S57Y | 562 |
| 255 | H: KT TRV & L: LP S57H | G100K/G104T G24T/S28R/G35V | 433 | V91L/S96P S57H | 563 |
| 256 | H: KT TRV & L: LP S57Q | G100K/G104T G24T/S28R/G35V | 433 | V91L/S96P S57Q | 564 |
| 257 | H: KT TRV & L: LP S57N | G100K/G104T G24T/S28R/G35V | 433 | V91L/S96P S57N | 565 |
| 258 | H: KT TRV & L: LP S57K | G100K/G104T G24T/S28R/G35V | 433 | V91L/S96P S57K | 566 |
| 259 | H: KT TRV & L: LP S57D | G100K/G104T G24T/S28R/G35V | 433 | V91L/S96P S57D | 567 |
| 260 | H: KT TRV & L: LP S57E | G100K/G104T G24T/S28R/G35V | 433 | V91L/S96P S57E | 568 |
| 261 | H: KT TRV & L: LP S57W | G100K/G104T G24T/S28R/G35V | 433 | V91L/S96P S57W | 569 |
| 262 | H: KT TRV & L: LP S57R | G100K/G104T G24T/S28R/G35V | 433 | V91L/S96P S57R | 570 |
| 263 | H: KT TRV & L: LP S57G | G100K/G104T G24T/S28R/G35V | 433 | V91L/S96P S57G | 571 |
| 264 | H: KT TRV Y105H & L: wt | G100K/G104T G24T/S28R/G35V Y105H | 435 | wildtype | 142 |
| 265 | H: KT TRV Y105N & L: wt | G100K/G104T G24T/S28R/G35V Y105N | 436 | wildtype | 142 |
| 266 | H: KT TRV Y107F & L: wt | G100K/G104T G24T/S28R/G35V Y107F | 437 | wildtype | 142 |
| 267 | H: KT TRV D109Q & L: wt | G100K/G104T G24T/S28R/G35V D109Q | 438 | wildtype | 142 |

Example 6

Surface Plasmon Resonance

In this example, the binding affinities of selected anti-DLL4 Fabs to recombinant human DLL4 (hDLL4, Cat# 1506-D4/CF, R&D Systems) were analyzed using Surface Plasmon Resonance (SPR) (Biosensor Tools, Salt Lake City, Utah). The Fabs analyzed include germline-derived antibodies and germline-modified DLL4 antibodies. Recombinant hDLL4 was immobilized on a SPR chip using amine coupling at three different surface densities. The Fabs were serially diluted 3-fold, with an initial concentration of 1 µM. Binding studies were run on a ProteOn system using a GLM sensor chip in 10 mM HEPES, pH 7.4, 150 mM NaCl, 0.01% Tween-20, and 0.1 mg/ml BSA at 25° C. The response data from each surface was globally fit to determine the binding constants.

The results are shown in Table 32 below. Tables 32 sets forth the Fab, the $k_a$ ($M^{-1}$ $s^{-1}$), the $k_d$ ($s^{-1}$), and the $K_D$ (nM) and standard deviation.

TABLE 32

Binding affinity of DLL4 Fabs

| Heavy Chain | Light Chain | $k_a (\times 10^5)$ $(M^{-1}s^{-1})$ | $k_d (s^{-1})$ | $K_D$ (nM) |
|---|---|---|---|---|
| VH5-51__IGHD5-18*01 > 3__IGHJ4*01 | V3-4__IGLJ1*01 | n/a | n/a | 4800 (±200) |
| VH5-51__IGHD5-18*01 > 3__IGHJ4*01 G100K/G104T (H: KT) | V3-4__IGLJ1*01 | 0.645 (±0.92) | 0.023 (±0.004) | 355 (±7) |
| VH5-51__IGHD5-18*01 > 3__IGHJ4*01 G100K/G104T S28R (H: KT S28R) | V3-4__IGLJ1*01 | 7.4 (±0.6) | 0.0845 (±0.0050) | 114 (±6) |
| VH5-51__IGHD5-18*01 > 3__IGHJ4*01 G100K/G104T G24T/S28R/G35V (H: KT TRV) | V3-4__IGLJ1*01 | 20.90 (±6.24) | 0.0717 (±0.00351) | 36.2 (±8.5) |
| VH5-51__IGHD5-18*01 > 3__IGHJ4*01 G100K/G104T G24T/S28R/G35V (H: KT TRV) | V3-4__IGLJ1*01 M94R/S96M (L: RM) | 25.30 (±4.16) | 0.101 (±0.0153) | 40.3 (±9.3) |
| VH5-51__IGHD5-18*01 > 3__IGHJ4*01 G100K/G104T G24T/S28R/G35V (KT TRV) | V3-4__IGLJ1*01 V91L/S96P (LP) | 110 | 0.036 | 3.3 |
| VH5-51__IGHD5-18*01 > 3__IGHJ4*01 G100K/G104T G24T/S28R/G35V (KT TRV) | V3-4__IGLJ1*01 V91L/S96P S52G (LP S52G) | 29.6 | 0.0147 | 5.0 |
| VH1-46__IGHD6-6*01__IGHJ1*01 | L6__IGKJ1*01 | 1.63 (±3) | 0.101 (±2) | 730 (±130) |
| VH1-46__IGHD6-6*01__IGHJ1*01 S104F | L6__IGKJ1*01 | 5.0 (±0.8) | 0.19 (±0.01) | 380 (±60) |
| VH1-46__IGHD6-6*01__IGHJ1*01 S102A/S103P/S104F (H: APF) | L6__IGKJ1*01 | 4.05 (±0.05) | 0.0492 (±0.0004) | 122 (±1) |
| VH1-46__IGHD6-6*01__IGHJ1*01 S102A/S103P/S104F/H111F (H: APFF) | L6__IGKJ1*01 | 4.25 (±0.04) | 0.0300 (±0.0002) | 70.6 (±0.7) |
| VH1-46__IGHD6-6*01__IGHJ1*01 S102A/S103P/S104F/H111Y (H: APFY) | L6__IGKJ1*01 | 3.40 (±0.03) | 0.0317 (±0.0002) | 93.1 (±0.9) |
| VH1-46__IGHD6-6*01__IGHJ1*01 S102A/S103P/S104F (APF) | L6__IGKJ1*01 S31K | 3.50 (0.0004) | 0.0392 (±0.05) | 112 (±2) |
| VH1-46__IGHD6-6*01__IGHJ1*01 S102A/S103P/S104F/H111F G56H (H: APFF G56H) | L6__IGKJ1*01 | 3.51 (±1.84) | 0.0101 (±0.000716) | 32.7 (±11.6) |
| VH1-46__IGHD6-6*01__IGHJ1*01 S102A/S103P/S104F/H111F (APFF) | L6__IGKJ1*01 S28N/S30D/S31H (NDH) | 4.44 | 0.0689 | *155.2 and 14 |
| VH1-46__IGHD6-6*01__IGHJ1*01 S102A/S103P/S104F/H111F I51V/N52L/S54T/G56H (H: APFF VLTH) | L6__IGKJ1*01 S28N/S30D/S31H (L: NDH) | 4.30 (±1.45) | 0.00113 (±0.000138) | 2.7 (±0.6) |
| VH1-46__IGHD6-6*01__IGHJ1*01 S102A/S103P/S104F/H111F I51V/N52L/S54T/G56H (H: APFF VLTH) | L6__IGKJ1*01 S28N/S30D/S31H S52L/A55S (L: NDH LS) | 6.84 (±2.51) | 0.00109 (±0.000106) | 1.7 (±0.5) |
| VH6-1__IGHD3-3*01__IGHJ4*01 | V4-3__IGLJ4*01 | n/a | n/a | 38000 (±4000) |
| VH1-46__IGHD3-10*01__IGHJ4*01 | L12__IGKJ1*01 | 5 (±1) | 0.29 (±2) | 500 (±100) |

$K_D = k_d/k_a$;
*Fab Fab VH1-46__IGHD6-6*01__IGHJ1*01 S102A/S103P/S104F/H111F & L6__IGKJ1*01 S28N/S30D/S31H displays 2-site binding: 89% with Kd of 155.2 nM and 10% with Kd of 14 nM.

Binding affinity of anti-DLL4 Fab H:KT TRV & L:RM and anti-DLL4 Fab H:APFF VLTH & L:NDH LS to recombinant mouse DLL4 (mDLL4, Cat# 1389-D4-050/CF, R&D Systems) were analyzed using SPR as described above for human DLL4. The results (see Table 33 below) showed that no binding could be detected on mouse surfaces for anti-DLL4 Fab H:KT TRV & L:RM. In contrast, anti-DLL4 Fab H:APFF VLTH & L:NDH LS showed binding to mouse DLL4 with an affinity of 9.7 (±2.0). Fab H:APFF VLTH & L:NDH LS, however, binds hDLL4 with 5-fold greater affinity as compared to mouse DLL4 (see Table 32 above).

TABLE 33

Fab VH1-46__IGHD6-6*01__IGHJ1*01 S102A/S103P/S104F/H111F I51V/N52L/S54T/G56H (H: APFF VLTH) & L6__IGKJ1*01 S28N/S30D/S31H S52L/A55S (L: NDH LS) binding to mDLL4

| mDLL4 | $k_a (M^{-1}s^{-1})$ | $k_d (s^{-1})$ | $K_D$ (nM) |
|---|---|---|---|
| Surface 1 | 2.87E+05 | 2.10E-03 | 7.3 |
| Surface 1 | 1.65E+05 | 0.00178 | 10.8 |
| Surface 1 | 1.73E+05 | 1.88E-03 | 10.9 |

TABLE 33-continued

Fab VH1-46__IGHD6-6*01__IGHJ1*01 S102A/S103P/S104F/H111F I51V/N52L/S54T/G56H (H: APFF VLTH) & L6__IGKJ1*01 S28N/S30D/S31H S52L/A55S (L: NDH LS) binding to mDLL4

| mDLL4 | $k_a (M^{-1}s^{-1})$ | $k_d (s^{-1})$ | $K_D$ (nM) |
|---|---|---|---|
| Average | 2.08E+05 | 1.92E-03 | 9.7 |
| Standard Deviation | 6.81E+04 | 1.63E-04 | 2.0 |

Example 7

ELISA Binding Assay

In this example, an ELISA binding assay was used to assess the dose-dependent binding of Fab antibodies to recombinant human DLL4 and recombinant mouse DLL4.

A. Assay

Briefly, 50 µl of a 0.5 µg/ml solution of hDLL4 or mDLL4 in 100 mM NaHCO$_3$, pH 9 was added to each well of a 96-well Costar plate (Cat # 3370, Corning Inc.) and allowed to incubate for 1 hour at room temperature. The plate was blocked by adding 1% BSA in Tris-buffered Saline Tween (TBST) and incubating for 1 hour at room temperature followed by washing 2 times with 150 μl TBST. A Fab antibody was serially diluted in 1% BSA in PBS. A 50 μl aliquot of each serial dilution was added, in triplicate, to each well and the plate was incubated for 1 hour at room temperature followed by washing 2 times with TBST. 50 μl of either goat anti-human kappa HRP conjugated secondary antibody (Cat # A7164-1 mL, Sigma-Aldrich) or goat anti-human lambda HRP conjugated secondary antibody (Cat # L1645-1 ml, Sigma-Aldrich), diluted 1:1000 in 1% BSA in PBS, was added to each well and the plate was incubated for 30 minutes at room temperature followed by washing 3 times with 200 μl TBST. Finally, 50 μl TMB one-component reagent (Cat # TMBW-1000-01, BioFax) was added and allowed to develop for 2 minutes at room temperature. The reaction was immediately halted by the addition of 50 μl 0.5M $H_2SO_4$ and the absorbance at 450 nm was measured using an ELISA plate reader.

B. Results

Tables 34-43 below set forth dose dependent binding of various Fabs for binding to DLL4.

Table 34 sets forth the binding of heavy chain mutant Fab H:AFP & L:wt (SEQ ID NOS:155 and 141) as compared to parent Fab VH1-46_IGHD6-6*01_IGHJ1*01 & L6_IGKJ1*01 (SEQ ID NOS:131 and 141), at Fab concentrations of 125 nm to 1000 nm. At the tested concentrations, the parent Fab antibody did not show a detectable signal for binding to DLL4. In contrast, the H:APF & L:wt triple mutant had a detectable signal evidencing DLL4 binding in a concentration dependent manner.

TABLE 34

Binding affinity of triple mutant Fab VH1-46_IGHD6-6*01_IGHJ1*01 S102A/S103P/S104F (H: APF) & L6_IGKJ1*01 as compared to parent Fab VH1-46_IGHD6-6*01_IGHJ1*01 & L6_IGKJ1*01

| Fab [nM] | Parent | Blank | S102A, S103P, S104F | Blank |
|---|---|---|---|---|
| 1000 | 0.071 | 0.060 | 0.463 | 0.080 |
| 500 | 0.070 | 0.069 | 0.307 | 0.074 |
| 250 | 0.069 | 0.064 | 0.231 | 0.071 |
| 125 | 0.070 | 0.066 | 0.173 | 0.075 |

Table 35 sets forth the binding of heavy chain mutants H:APFF LTH, H:APFF ELTH, H:APFF VLTH, H:APFF NLTH, H:APFF TLATH, and H:APFF TV paired with light chain L6_IGKJ1*01 (SEQ ID NO:141), at Fab concentrations of 0.16 nM to 20 nM. Fabs containing heavy chain mutants H:APFF LTH (SEQ ID NO:233), H:APFF ELTH (SEQ ID NO: 238), H:APPF VLTH (SEQ ID NO: 239) and H:APFF NLTH (SEQ ID NO: 244) bind DLL4 with a Kd of approximately between 1 nM and 10 nM. Fabs containing heavy chain mutants H:APFF TLATH (SEQ ID NO: 251) and H:APFF TV (SEQ ID NO: 201) have lower affinity for DLL4 as compared to the other tested Fabs. Heavy chain mutant H:APFF TLATH has an approximate Kd greater than 100 nM and heavy chain mutant H:APFF TV has a Kd between 10 and 100 nM.

TABLE 35

Heavy chain Fab mutants of VH1-46_IGHD6-6*01_IGHJ1*01 & L6_IGKJ1*01 (SEQ ID NO: 141) binding to DLL4 by ELISA

| | Heavy Chain | | | | | |
|---|---|---|---|---|---|---|
| | APFF LTH | APFF ELTH | APFF VLTH | APFF NLTH | APFF TLATH | APFF I51T/N52V |
| | Light Chain | | | | | |
| Fab [nM] | L6_IGKJ1*01 | L6_IGKJ1*01 | L6_IGKJ1*01 | L6_IGKJ1*01 | L6_IGKJ1*01 | L6_IGKJ1*01 |
| 20 | 2.402 | 2.290 | 2.052 | 1.627 | 1.109 | 0.648 |
| 10 | 2.345 | 2.168 | 1.854 | 1.362 | 0.875 | 0.506 |
| 5 | 2.477 | 2.333 | 2.198 | 1.751 | 1.272 | 0.724 |
| 2.5 | 2.151 | 1.982 | 1.656 | 1.165 | 0.592 | 0.358 |
| 1.3 | 0.653 | 0.402 | 0.252 | 0.143 | 0.078 | 0.055 |
| 0.63 | 1.367 | 1.010 | 0.785 | 0.419 | 0.227 | 0.115 |
| 0.31 | 2.402 | 2.290 | 2.052 | 1.627 | 1.109 | 0.648 |
| 0.16 | 2.345 | 2.168 | 1.854 | 1.362 | 0.875 | 0.506 |

Table 36 sets for the binding of heavy chain mutants H:APFF (SEQ ID NO:156), H:APFF G56A (SEQ ID NO:197) and H:APFF S54A (SEQ ID NO:195) paired with light chain L6_IGKJ1*01 (SEQ ID NO:141) and light chain mutant L:NDH (SEQ ID NO:343), at Fab concentrations of 50 to 100 nM. Fab mutant H:APFF & L:NDH binds DLL4 with 4-fold increased affinity as compared to Fab mutant APFF. The antibody Fab H:APFF G56A & L:NDH resulted in 8-fold greater affinity for binding to DLL4 as compared to the H:APFF & L:wt antibody mutant, and also exhibited increased binding affinity compared to the other antibodies tested. The antibody Fab H:APFF S54A & L:NDH resulted in a slight decrease in binding affinity compared to the H: APFF & L:NDH antibody mutant.

TABLE 36

Binding affinity of VH1-46_IGHD6-6*01_IGHJ1*01 & L6_IGKJ1*01 Fab mutants

| | Heavy Chain | | | | |
|---|---|---|---|---|---|
| | APFF | APFF | APFF G56A | APFF G56A | APFF S54A |
| | | | Light Chain | | |
| Fab [nM] | Parent | NDH | Parent | NDH | NDH |
| 100 nM | 0.072 | 0.259 | 0.338 | 0.453 | 0.213 |
| 75 nM | 0.072 | 0.268 | 0.399 | 0.543 | 0.212 |
| 50 nM | 0.060 | 0.202 | 0.301 | 0.366 | 0.154 |
| 0 | 0.006 | 0.002 | 0.002 | 0.002 | 0.000 |

Table 37 sets forth the binding of heavy chain mutant H:APFF (SEQ ID NO:156) paired with light chain mutants L:NDH (SEQ ID NO:343), L:NDH S52L (SEQ ID NO:351), L:NDH S52T (SEQ ID NO:352), L:NDH N53H (SEQ ID NO:363), L:NDH A55S (SEQ ID NO:367) and L:NDH A55G (SEQ ID NO:368), at Fab concentrations of 3.125 nM to 100 nM. Fabs H:APFF & L:NDH S52L, H:APFF & L:NDH A55S and H:APFF & L:NDH A55G had a slightly increased affinity for binding to DLL4 as compared to Fab H:APFF & L:NDH mutant. All of the Fab light chain mutants bind DLL4 within the same range of affinity as Fab H:APFF & L:NDH mutant.

TABLE 37

Fab VH1-46_IGHD6-6*01_IGHJ1*01 S102A/S103P/S104F/H111F (APFF) (SEQ ID NO: 156) & L6_IGKJ1*01 S28N/S30D/S31H (NDH) light chain S52, N53 and A55 mutant binding to DLL4 by ELISA

| | H | | | | | |
|---|---|---|---|---|---|---|
| | APFF | APFF | APFF | APFF | APFF | APFF |
| | | | L | | | |
| Fab [nM] | NDH S52L | NDH S52T | NDH N53H | NDH A55S | NDH A55G | NDH |
| 100 | 0.791 | 0.653 | 0.608 | 0.858 | 0.814 | 0.686 |
| 50 | 0.546 | 0.490 | 0.416 | 0.588 | 0.510 | 0.507 |
| 25 | 0.335 | 0.323 | 0.238 | 0.407 | 0.316 | 0.310 |

TABLE 37-continued

Fab VH1-46_IGHD6-6*01_IGHJ1*01 S102A/S103P/S104F/H111F (APFF) (SEQ ID NO: 156) & L6_IGKJ1*01 S28N/S30D/S31H (NDH) light chain S52, N53 and A55 mutant binding to DLL4 by ELISA

| | H | | | | | |
|---|---|---|---|---|---|---|
| | APFF | APFF | APFF | APFF | APFF | APFF |
| | | | L | | | |
| Fab [nM] | NDH S52L | NDH S52T | NDH N53H | NDH A55S | NDH A55G | NDH |
| 12.5 | 0.215 | 0.215 | 0.167 | 0.258 | 0.198 | 0.192 |
| 6.25 | 0.142 | 0.130 | 0.109 | 0.154 | 0.125 | 0.125 |
| 3.125 | 0.095 | 0.099 | 0.089 | 0.108 | 0.093 | 0.096 |

Table 38 sets forth the binding of heavy chain mutants H:APFF LTH (SEQ ID NO:233), H:APFF ALTH (SEQ ID NO:234), and H:APFF VLTH (SEQ ID NO:239) paired with light chain mutants L:NDH (SEQ ID NO:343), L:NDH LG (SEQ ID NO:369), and L:NDH LS (SEQ ID NO:370), at Fab concentrations of 0.74 nM to 20 nM. Antibodies containing the H:APFF LTH and H:APFF VLTH heavy chain mutations had approximately 10-fold increased binding affinity to DLL4 compared to the antibody mutants containing the heavy chain mutant H:APFF ALTH.

TABLE 38

Fab VH5-51_IGHD5-18*01 > 3_IGHJ4*01 & V3-4_IGLJ*01 mutant binding to DLL4 by ELISA

| Heavy Chain VH1-46_IGHD6-6*01_IGHJ1*01 | Light Chain L6_IGKJ1*01 | Fab [nM] | | | |
|---|---|---|---|---|---|
| S102A/S103P/S104F/H111F (APFF) | S28N/S30D/S31H (NDH) | 20 | 6.67 | 2.22 | 0.74 |
| N52L/S54T/G56H (LTH) | (NDH) | 0.863 | 0.739 | 0.463 | 0.270 |
| N52L/S54T/G56H (LTH) | S52L/A55G (NDH LG) | 1.008 | 0.880 | 0.594 | 0.368 |
| N52L/S54T/G56H (LTH) | S52L/A55S (NDH LS) | 1.054 | 0.916 | 0.557 | 0.398 |
| I51A/N52L/S54T/G56H (ALTH) | (NDH) | 0.391 | 0.232 | 0.069 | 0.024 |
| I51A/N52L/S54T/G56H (ALTH) | S52L/A55G (NDH LG) | 0.390 | 0.212 | 0.069 | 0.028 |
| I51A/N52L/S54T/G56H (ALTH) | S52L/A55S (NDH LS) | 0.458 | 0.282 | 0.040 | 0.046 |
| I51V/N52L/S54T/G56H (VLTH) | (NDH) | 0.979 | 0.776 | 0.608 | 0.288 |
| I51V/N52L/S54T/G56H (VLTH) | S52L/A55G (NDH LG) | 1.057 | 0.916 | 0.755 | 0.397 |
| I51V/N52L/S54T/G56H (VLTH) | S52L/A55S (NDH LS) | 0.910 | 0.747 | 0.523 | 0.263 |

Table 39 sets forth the binding of heavy chain mutants H:KT (SEQ ID NO:384), H:KT S28R (SEQ ID NO:414), H:KT LRV (SEQ ID NO:420), H:KT TRV (SEQ ID NO:433) and H:KT ARV (SEQ ID NO:434) paired with light chain L:wt (SEQ ID NO:142) and light chain mutant L:RM (SEQ ID NO:479), at Fab concentrations of 0.74 nM to 20 nM. Fab KT TRV-V3-4 RM had the greatest binding affinity for DLL4.

TABLE 39

Fab VH5-51__IGHD5-18*01 > 3__IGHJ4*01 & V3-4__IGLJ*01 mutant binding to DLL4 by ELISA

| Heavy Chain | Light Chain | Fab [nM] | | | |
|---|---|---|---|---|---|
| VH5-51__IGHD5-18*01 > 3__IGHJ4*01 | V3-4__IGLJ*01 | 20 | 6.67 | 2.22 | 0.74 |
| G100K/G104T | parent | 0.018 | 0.042 | 0.014 | 0.019 |
| G100K/G104T S28R | parent | 0.009 | 0.003 | 0.000 | 0.000 |
| G100K/G104T G24L/S28R/G35V | parent | 0.027 | 0.005 | 0.000 | 0.006 |
| G100K/G104T G24T/S28R/G35V | parent | 0.054 | 0.023 | 0.000 | 0.002 |
| G100K/G104T G24A/S28R/G35V | parent | 0.054 | 0.025 | 0.002 | 0.008 |
| G100K/G104T | M94R/S96M | 0.087 | 0.023 | 0.007 | 0.000 |
| G100K/G104T S28R | M94R/S96M | 0.011 | 0.001 | 0.003 | 0.000 |
| G100K/G104T G24L/S28R/G35V | M94R/S96M | 0.003 | 0.000 | 0.000 | 0.000 |
| G100K/G104T G24T/S28R/G35V | M94R/S96M | 0.122 | 0.062 | 0.028 | 0.006 |
| G100K/G104T G24A/S28R/G35V | M94R/S96M | 0.006 | 0.034 | 0.000 | 0.000 |

Table 40 sets forth the binding of heavy chain mutant H:KT TRV (SEQ ID NO:433) paired with light chain mutants L:wt (SEQ ID NO:142), L:LP (SEQ ID NO:537), L:LP S52M (SEQ ID NO:523) and L:LP S52G (SEQ ID NO:536), at Fab concentrations of 100 nM to 0.05 nM. Fab H:KT TRV & L:LP S52G had the greatest binding affinity for DLL4.

TABLE 40

Bindign affinity of Fab VH5-51__IGHD5-18*01 > 3__IGHJ4*01 G100K/G104T/G24T/S28R/G35V (KT TRV) & V3-4__IGLJ1*01 light chain mutants

| | Heavy Chain | | | |
|---|---|---|---|---|
| | KT TRV | KT TRV | KT TRV | KT TRV |
| | | | Light Chain | |
| Fab [nM] | Wildtype | V91L/S96P | S52M | V91L/S96P S52G |
| 100 | 0.16 | 0.34 | 0.24 | 0.69 |
| 33.33 | 0.08 | 0.19 | 0.12 | 0.35 |
| 11.11 | 0.04 | 0.07 | 0.06 | 0.17 |
| 3.70 | 0.03 | 0.03 | 0.03 | 0.06 |
| 1.23 | 0.01 | 0.03 | 0.03 | 0.03 |
| 0.41 | 0.01 | 0.02 | 0.03 | 0.01 |
| 0.14 | 0.00 | 0.03 | 0.02 | 0.02 |

Table 41 sets forth the binding affinity of heavy chain mutants of VH5-51_IGHD5-18*01>3_IGHJ4*01, including H:G100K (SEQ ID NO:381), H:G104T (SEQ ID NO:383), H:KT (SEQ ID NO:384), H:KT S28R (SEQ ID NO:414), H:KT TRV (SEQ ID NO:433), H:KT TRV Y105H (SEQ ID NO:435), H:KT TRV Y105N (SEQ ID NO:436), H:KT TRV Y107F (SEQ ID NO:437), and H:KT TRV D1090 (SEQ ID NO:438) with light chain mutants L:wt (SEQ ID NO:142), L:LP (SEQ ID NO:537) and various L:LP S52 mutants (SEQ ID NOS:520-531 and 536), at Fab concentrations of 100 nM to 12.5 nM. Fab H:KT TRV & L:LP S52G (SEQ ID NOS:433 and 536) had the greatest affinity for binding to DLL4.

TABLE 41

Fab VH5-51_IGHD5-18*01 > 3_IGHJ4*01 & V3-4_IGLJ*01 mutant binding to DLL4 by ELISA

| Heavy Chain | Light Chain | Fab [nM] | | | |
|---|---|---|---|---|---|
| VH5-51_IGHD5-18*01 > 3_IGHJ4*01 | V3-4_IGLJ*01 | 100 | 50 | 25 | 12.5 |
| G100K/G104T G24L/S28R/G35V Y105H | Wildtype | 0.23 | 0.20 | 0.19 | 0.21 |
| G100K/G104T G24T/S28R/G35V Y105N | Wildtype | 0.25 | 0.18 | 0.19 | 0.21 |
| G100K/G104T G24A/S28R/G35V Y107F | Wildtype | 0.28 | 0.24 | 0.20 | 0.21 |
| G100K/G104T G24L/S28R/G35V D109Q | Wildtype | 0.30 | 0.25 | 0.22 | 0.24 |
| G100K/G104T G24T/S28R/G35V | V91L/S96P | 1.00 | 0.81 | 0.58 | 0.45 |
| G100K | Wildtype | 0.20 | 0.19 | 0.18 | 0.19 |
| Wildtype | Wildtype | 0.17 | 0.16 | 0.18 | 0.17 |
| G104T | Wildtype | 0.17 | 0.17 | 0.18 | 0.19 |
| G100K/G104T | Wildtype | 0.18 | 0.18 | 0.16 | 0.18 |
| G100K/G104T G24T/S28R/G35V | Wildtype | 0.45 | 0.32 | 0.26 | 0.23 |
| G100K/G104T S28R | Wildtype | 0.26 | 0.23 | 0.20 | 0.18 |
| G100K/G104T G24A/S28R/G35V | V91L/S96P S52V | 0.95 | 0.74 | 0.60 | 0.43 |
| G100K/G104T G24L/S28R/G35V | V91L/S96P S52F | 0.99 | 0.69 | 0.49 | 0.42 |
| G100K/G104T G24T/S28R/G35V | V91L/S96P S52L | 1.02 | 0.78 | 0.58 | 0.43 |
| G100K/G104T G24A/S28R/G35V | V91L/S96P S52I | 1.04 | 0.82 | 0.60 | 0.40 |
| G100K/G104T G24L/S28R/G35V | V91L/S96P S52M | 1.01 | 0.80 | 0.59 | 0.41 |
| G100K/G104T G24T/S28R/G35V | V91L/S96P S52G | 1.14 | 1.02 | 0.90 | 0.63 |
| G100K/G104T G24A/S28R/G35V | V91L/S96P S52P | 1.00 | 0.79 | 0.59 | 0.43 |
| G100K/G104T G24L/S28R/G35V | V91L/S96P S52T | 0.99 | 0.79 | 0.62 | 0.41 |
| G100K/G104T G24T/S28R/G35V | V91L/S96P S52Y | 0.90 | 0.72 | 0.56 | 0.41 |
| G100K/G104T G24A/S28R/G35V | V91L/S96P S52H | 1.09 | 0.91 | 0.73 | 0.50 |
| G100K/G104T G24L/S28R/G35V | V91L/S96P S52Q | 0.96 | 0.81 | 0.67 | 0.47 |
| G100K/G104T G24T/S28R/G35V | V91L/S96P S52N | 1.05 | 0.90 | 0.86 | 0.65 |
| G100K/G104T G24T/S28R/G35V | V91L/S96P S52K | 1.23 | 1.03 | 0.79 | 0.56 |

Tables 42-43 set forth the ELISA signals for binding to human and mouse DLL4. All tested Fabs show a preference for binding to hDLL4 as compared to mDLL4. Fabs H:APFF VLTH & L:NDH LS (SEQ ID NOS:239 and 370) and H:APFF VLTH & L:NDH (SEQ ID NOS:239 and 343) bind hDLL4 with approximately the same affinity, approximately 1 nM. Additionally, Fab H:APFF VLTH & L:NDH LS binds mDLL4 with 10-fold decrease affinity as compared to binding to hDLL4. Fab H:KT TRV & L:wt (SEQ ID NOS:433 and 142) binds hDLL4 with an affinity of approximately 50 nM. None of the tested VH5-51_IGHD5-18*01>3_IGHJ4*01 & V3-4_IGLJ1*01 mutant Fabs showed appreciable binding to mDLL4 at the tested concentrations.

TABLE 42

Fab VH1-46_IGHD6-6*01_IGHJ1*01 & L6_IGKJ1*01 mutant binding to human and mouse DLL4 by ELISA

| | 0.5 ng/µl h DLL4 | | | 0.5 ng/µl mDLL4 | | |
|---|---|---|---|---|---|---|
| | Heavy | | | | | |
| | APFF G56H | APFF VLTH | APFF VLTH | APFF G56H | APFF VLTH | APFF VLTH |
| | Light | | | | | |
| Fab [nM] | L6_IGKJ1*01 | NDH | NDH LS | L6_IGKJ1*01 | NDH | NDH LS |
| 10.00 | 1.199 | 2.253 | 2.246 | 0.088 | 1.215 | 1.555 |
| 5.00 | 0.882 | 1.918 | 2.060 | 0.070 | 0.833 | 1.284 |
| 2.50 | 0.535 | 1.831 | 1.964 | 0.061 | 0.583 | 0.983 |
| 1.25 | 0.264 | 1.396 | 1.651 | 0.054 | 0.317 | 0.604 |
| 0.63 | 0.168 | 1.089 | 1.403 | 0.052 | 0.206 | 0.404 |
| 0.31 | 0.103 | 0.683 | 0.850 | 0.049 | 0.105 | 0.205 |
| 0.16 | 0.079 | 0.407 | 0.593 | 0.048 | 0.081 | 0.142 |
| 0.08 | 0.071 | 0.189 | 0.259 | 0.048 | 0.063 | 0.078 |

TABLE 43

Fab VH5-51_IGHD5-18*01 > 3_IGHJ4*01 & V3-4_IGLJ*01 mutant binding to human and mouse DLL4 by ELISA

| | 0.5 ng/μl h DLL4 | | | 0.5 ng/μl mDLL4 | | |
|---|---|---|---|---|---|---|
| Heavy | KT S28R | KT TRV | KT TRV | KT S28R | KT TRV | KT TRV |
| Light | | | | | | |
| Fab [nM] | V3-4_IGLJ1*01 | V3-4_IGLJ1*01 | RM | V3-4_IGLJ1*01 | V3-4_IGLJ1*01 | RM |
| 100.00 | 0.670 | 1.447 | 1.067 | 0.158 | 0.305 | 0.457 |
| 50.00 | 0.524 | 0.976 | 0.661 | 0.145 | 0.234 | 0.331 |
| 25.00 | 0.333 | 0.600 | 0.421 | 0.138 | 0.178 | 0.232 |
| 12.50 | 0.226 | 0.389 | 0.294 | 0.126 | 0.153 | 0.186 |
| 6.25 | 0.203 | 0.310 | 0.229 | 0.123 | 0.133 | 0.148 |
| 3.13 | 0.164 | 0.187 | 0.167 | 0.117 | 0.125 | 0.131 |
| 1.56 | 0.148 | 0.183 | 0.148 | 0.116 | 0.120 | 0.131 |
| 0.78 | 0.138 | 0.143 | 0.145 | 0.118 | 0.115 | 0.130 |

Example 8

Binding to DLL4 Expressed on the Surface of CHO Cells

In this example, Fabs H:APFF VLTH & L:NDH LS (SEQ ID NOS:239 and 371) and H:KT TRV & L:LP S52G (SEQ ID NOS:433 and 536) were tested for their ability to bind to DLL4 expressed on the surface of CHO cells as detected by flow cytometry.

To generate a DLL4 expression construct, human DLL4 cDNA (SEQ ID NO:113, Accession No. BC106950; and encoding amino acids set forth in SEQ ID NO:114, Accession No. AAI06951) in pCR-BluntII-TOPO (SEQ ID NO:116) as a glycerol stock was obtained from Open Biosystems (Clone ID# 40034887). The stock was streaked on kanamycin agar plates and a colony picked for purification of the DNA. DNA was obtained with Purelink™ Quick Plasmid Miniprep Kit (Invitrogen, Catalog # K210010).

Full-length DLL4 was digested out from the OpenBiosystems vector and ligated into pcDNA5/FRT (SEQ ID NO:117; Invitrogen Catalog # K601001) between NheI and NotI. Ligation was performed with Rapid DNA Ligation Kit (Roche, Catalog #11 635 379 001) and cells transformed using heat shock into One Shot® Max Efficiency® DH5™-T1$^R$ Competent Cells (Invitrogen, Catalog #12297016). Cells were selected on carbenicillin plates. Colonies were picked and inoculated overnight in luria broth (LB) containing 1:1000 100 mg/mL carbenicillin. Plasmid DNA was extracted by miniprep (Invitrogen; Catalog # K210011).

Using Invitrogen's Lipofectamine™ Transfection Reagent, pcDNA5/FRT containing full-length DLL4 and pOG44 recombinase vector (SEQ ID NO:118; Invitrogen Catalog # K601001) were transfected into Invitrogen's Flp-In™-CHO Cell Line (Cat. No. R75807) according to Flp-In™ System protocol. Cells were approximately 90% confluent in a 12-well plate. Transfected cells were selected with 400 μg/ml Hygromycin after a couple days. Colonies were picked about 5 days after and transferred into a 10 cm² tissue culture dish. These cell lines were maintained with hygromycin selection CHO cells expressing full-length DLL4 and control CHO cells were detached from tissue culture plates (BD Falcon 10 cm²) using Accutase™ Enzyme Cell Detachment Medium (Cat# 00-4555-56, eBioscience). After washing the cells in 2% Bovine Serum Albumin in Phosphate Buffered Saline (2% BSA/PBS), 10 nM Fab in 2% BSA/PBS was added and incubated at on ice for 30 minutes. The cells were washed one time with 2% BSA/PBS and mouse anti-human kappa-PE antibody (diluted 1:100, Cat# MH10514, Invitrogen) or mouse anti-human lambda-PE antibody (diluted 1:100, Cat# MH10614, Invitrogen) was added and incubated on ice for 10 minutes. Secondary antibody mouse anti-human kappa-PE alone (without Fab) was used as a control for DLL4-expressing CHO cells. The cells were then washed twice in 2% BSA/PBS and analyzed by flow cytometry on a BD FACSAria. The results show that the tested Fabs bind DLL4 expressed on the surface of CHO cells.

Example 9

Epitope Mapping of DLL4

In this example, the binding epitopes of the VH1-46_IGHD6-6*01_IGHJ1*01 & L6_IGKJ1*01 and VH5-51_IGHD5-18*01>3_IGHJ4*01 & V3-4_IGLJ1*01 Fabs for DLL4 were mapped using two different assays. In the first experiment, a competition assay was performed to determine whether Fabs VH1-46_IGHD6-6*01_IGHJ1*01 H:APFF G56H & L6_IGKJ1*01 (SEQ ID NOS:219 and 141) and VH5-51_IGHD5-18*01>3_IGHJ4*01 H:KT TRV & V3-4_IGLJ1*01 (SEQ ID NOS:433 and 142) compete for the same binding site on DLL4. In the second experiment, the epitopes on DLL4 recognized by Fabs VH1-46_IGHD6-6*01_IGHJ1*01 H:APFF VLTH & L6_IGKJ1*01 L:NDH LS (SEQ ID NOS:239 and 370) and VH5-51_IGHD5-18*01>3_IGHJ4*01 H:KT TRV & V3-4_IGLJ1*01 L:LP S52G (SEQ ID NOS:433 and 536) were mapped by Western Blot using various truncated forms of DLL4.

A. Competition Assay for Binding to DLL4

In this assay, two Fabs, H:APFF G56H & L:wt and H:KT TRV & L:wt, that contain different heavy and light chains but have similar binding affinities to DLL4 ($K_D$s of 32.7±11.6, 36.2±8.5 nM, respectively), were used in a competition assay for binding to DLL4 with ruthenium labeled Fab H:APF & L:wt.

Briefly, single spot 96-well standard plates (MSD) were coated overnight with 5 μl per well of 10 μg/ml DLL4 (R&D systems) in PBS with 0.03% Triton X-100. Some wells were left uncoated as blank. The next day, an 150 μl aliquot of 3% BSA in TBST was added to each well and allowed to incubate for 60 min at 20° C. to block the plate. After washing twice with 150 μl TBST and tap drying, 50 μl aliquots of 100 nM Ru-labeled Fab H:APF & L:wt plus serial dilutions of either Fab H:APFF G56H & L:wt or Fab H:KT TRV & L:wt, in duplicates, were added. After incubating the plate at 20° C. with shaking for 1 hour, the ECL signal was measured using a Sector Imager 2400. After subtracting the signals from the blank wells, percent (%) Ru-labeled Fab H:APF & L:wt binding was calculated by dividing the average ECL signal for the tested Fabs with the ECL signal for Ru-labeled Fab H:APF & L:wt binding.

The results show that at equilibrium Fab H:APFF G56H & L:wt competes efficiently with Fab H:APF & L:wt for binding on DLL4, with a competition $K_D$ of about 30 nM. In contrast, Fab H:KT TRV & L:wt shows much weaker competition. At a concentration of 400 nM, Fab H:KT TRV & L:wt only competes off 33% of Ru-labeled Fab H:APF & L:wt. Thus Fabs H:APFF G56H & L:wt and H:KT TRV & L:wt have either minimal overlapping or different epitopes on DLL4.

B. Epitope Mapping

In this example, a series of recombinant DLL4 extracellular domain truncation mutants were generated, expressed and purified in order to allow for mapping of the binding epitopes of the Fabs on DLL4 by Western Blot.

1. Generation and Transfection of DLL4-Expression Constructs

CHO cells expressing the extracellular domain (ECD) of DLL4 were generated using pcDNA5/FRT vector from Invitrogen's Flp-In™ System. In this example, human DLL4 cDNA (SEQ ID NO:113, Accession No. BC106950, start codon for DLL4 at nucleotide position 137; and encoding amino acids set forth in SEQ ID NO:114, Accession No. AAI06951) in pCR-BluntII-TOPO (SEQ ID NO:116) as a glycerol stock was obtained from Open Biosystems (Clone ID# 40034887). The stock was streaked on kanamycin agar plates. and a colony picked for purification of the DNA. DNA was obtained with Purelink™ Quick Plasmid Miniprep Kit (Invitrogen, Catalog # K210010).

To obtain the ECD of DLL4 (corresponding to nucleotides 137-1708 of SEQ ID NO:113, and encoding amino acids 1-524 of SEQ ID NO:14), primers were generated for PCR as set forth in Table 44. The primers also were used to generate other truncated fragments of DLL4 (see Table 45). An extra 8 nucleotides and an NheI restriction site (SEQ ID NO:109) were added to the beginning of the ECD with the DLL4 ECD forward primer. A myc tag, his tag, NotI restriction site (SEQ ID NO:112) and 8 extra nucleotides were added to the end of the ECD using DLL4 ECD reverse2 primer. PCR was conducted with Pfu Ultra™ HF polymerase (Stratagene, La Jolla, Calif.; Catalog No. 600385) as described by the manufacturer. Seven different DLL4 constructs were amplified as described in Table 45 using different combinations of the PCR primers.

TABLE 44

Primers for DLL4 ECD and for DLL4 truncation PCR

| Primer Name | Primer | SEQ ID NO |
|---|---|---|
| DLL4 ECD forward | tgacctaggctagcatggcggcagcgtcccg | 119 |
| DLL4 ECD reverse 1 | cagatcctcttctgagatgagtttttgttcc ggcaagcccacgggga | 120 |
| DLL4 ECD reverse 2 | ttactgacgcggccgctcatcaatggtgatg gtgatgatgcagatcctcttctgagatg | 121 |
| DLL4 pre-DSL reverse 1 | ttactgacgcggccgctcatcacagatcctcttctg agatgagtttttgttcccggtaagagtagcgcagc | 122 |
| DLL4 DSL reverse 1 | ttactgacgcggccgctcatcacagatcctcttctga gatgagtttttgttcgcaatattccccagtccaacc | 123 |
| DLL4 Egf1 reverse 1 | ttactgacgcggccgctcatcacagatcctcttctg agatgagtttttgttcgttacacagccggccctgc | 124 |
| DLL4 Egf2 reverse 1 | CAGATCCTCTTCTGAGATGAGTTTTTGTTCG TTGAGATCTTGGTCACAAAAC | 901 |
| DLL4 Egf4 reverse 1 | ttactgacgcggccgctcatcacagatcctcttctga gatgagtttttgttcttcacaatgcaggccatagta | 125 |
| DLL4 Egf7 reverse 1 | ttactgacgcggccgctcatcacagatcctcttctg agatgagtttttgttcctcacagcgtcggccagag | 126 |

TABLE 45

DLL4 Constructs

| Construct | PCR Primers for Amplification |
|---|---|
| DLL4 ECD (amino acids 1-524) | primers DLL4 ECD forward and DLL4 ECD reverse1 and reverse2 |
| DLL4 pre-DSL (amino acid: 1-172) | primers DLL4 ECD forward and DLL4 pre-DSL reverse1 then DLL4 ECD reverse2 |
| DLL4 DSL (amino acid: 1-217) | primers DLL4 ECD forward and DLL4 DSL reverse1 then DLL4 ECD reverse2 |

TABLE 45 -continued

DLL4 Constructs

| Construct | PCR Primers for Amplification |
|---|---|
| DLL4 Egf1 (amino acid: 1-251) | primers DLL4 ECD forward and DLL4 EGF1 reverse1 then DLL4 ECD reverse2 |
| DLL4 Egf2 (amino acid: 1-282) | primers DLL4 ECD forward and DLL4 EGF2 reverse1 then DLL4 ECD reverse2 |
| DLL4 Egf4 (amino acid: 1-360) | primers DLL4 ECD forward and DLL4 EGF4 reverse1 then DLL4 ECD reverse2 |
| DLL4 Egf7 (amino acid: 1-476) | primers DLL4 ECD forward and DLL4 EGF7 reverse1 then DLL4 ECD reverse2 |

The respective PCR product and pcDNA5/FRT (SEQ ID NO:117; Invitrogen, Carlsbad, Calif., Catalog # K601001) were digested with NheI and NotI (SEQ ID NOS:109 and 112; New England Biosystem) and gel purified using Purelink™ Quick Gel Extraction and PCR Purification Kit (Invitrogen, Catalog # $K_{220001}$). The gel purified products were ligated with Rapid DNA Ligation Kit (Roche, Catalog # 11 635 379 001) and transformed using heat shock into One Shot® Max Efficiency® DH5™-T1$^R$ Competent Cells (Invitrogen, Catalog # 12297016). Cells were selected on carbenicillin plates. Colonies were picked and inoculated overnight in luria broth (LB) containing 1:1000 100 mg/mL carbenicillin. Plasmid DNA was extracted by miniprep (Invitrogen; Catalog # K210011).

Using Invitrogen's Lipofectamine™ Transfection Reagent, pcDNA5/FRT containing DLL4 ECD or constructs and pOG44 recombinase vector (SEQ ID NO:118; Invitrogen Catalog # K601001) were transfected into Invitrogen's Flp-In™-CHO Cell Line (Cat. No. R75807) according to Flp-In™ System protocol (Invitrogen; Flp-In System Complete Kit Cat. No. K601001). Cells were approximately 90% confluent in a 12-well plate. Transfected cells were selected with 400 μg/ml Hygromycin after a couple days. Colonies were picked about 5 days after and transferred into a 10 cm² tissue culture dish. These cell lines were maintained with hygromycin selection 2. Epitope Mapping by Western Blot Media from transfected CHO cells was collected after 7 days. To enrich for the DLL4 protein, 1 ml aliquots of each sample were batch bound with 50 μl of Talon Resin for 30 minutes. To confirm protein production media samples were tested with mouse anti-c-myc mAb (Genescript; Catalog # A00704). Samples were washed and then boiled with loading dye in the presence or absence of DTT. A gel was run on each of the 2 samples for each condition: with DTT and without DTT. The gel was transferred to PVDF membrane and probed with either 0.5 μg/ml anti-c-myc, 20 nM Fab VH1-46_IGHD6-6*01_IGHJ1*01 H:APFF VLTH & L6_IGKJ1*01 L:NDH LS (SEQ ID NOS:239 and 370) or 20 nM Fab VH5-51_IGHD5-18*01>3_IGHJ4*01 H:KT TRV & V3-4_IGLJ1*01 L:LP S52G (SEQ ID NOS:433 and 536). For detection goat anti-mouse HRP, goat anti-kappa HRP, and goat anti-lambda HRP were used, respectively.

Using the anti-myc antibody, the results show detection of all expressed proteins, except for the protein expressed from the pre-DSL construct, under reducing conditions. Under non-reducing conditions, only truncated proteins expressed from the DLL4 ECD and EGF4 constructs were detected using the anti-myc antibody. Binding of Fab H:APFF VLTH & L:NDH LS was detected by Western Blot under non-reducing conditions to the truncated protein expressed from the EGF7 construct, the EGF4 construct, EGF2 construct and the DLL4 ECD construct, but not to the proteins expressed from the other constructs tested. Binding of Fab H:KT TRV & L:LP S52G was detected by Western Blot under non-reducing conditions to the truncated protein expressed from the EGF7 construct, the EGF4 construct, and the DLL4 ECD construct, but not to the proteins expressed from the other constructs tested. This suggests that the DLL4 epitope recognized by the H:APFF VLTH & L:NDH LS antibody is within amino acid residues 252 to 280 of DLL4 in the EGF2 region while the epitope recognized by the H:KT TRV & L:LP S52G antibody is within amino acid residues 283 to 360 of DLL4 in the EGF3 to EGF4 region. Both anti-DLL4 Fabs appear to recognize conformational epitopes formed in the presence of disulfide bonds because their binding was abolished when the DLL4 protein was first treated with a reducing reagent.

Example 10

Inhibition of DLL4-Notch Interaction by ELISA

In this example, four Fabs previously identified as binding to DLL4 were functionally screened for their ability to block the binding of Notch-Fc to DLL4.

In this ELISA assay, recombinant human DLL4 was bound to the plate followed by the addition of both the Fab and Notch-Fc. An anti-human FC-HRP conjugated antibody was used as a detection molecule therefore if Notch-Fc binds to DLL4, a strong signal will be observed at $A_{450}$. Alternatively, if the Fab is capable of blocking the binding of Notch-Fc to DLL4, no signal should be observed. The DLL4 Fabs that were assayed included Fab H:APF & L6_IGKJ1*01 (SEQ ID NOS:155 and 141), Fab H:APFF & L6_IGKJ1*01 (SEQ ID NOS:156 and 141), Fab H:KT & V3-4_IGLJ1*01 (SEQ ID NOS:385 and 142) and Fab VH1-46_IGHD3-10*01_IGHJ4*01 & L12_IGKJ1*01 (SEQ ID NOS:134 and 147).

In short, Maxisorp Nunc 96-well plates were coated with 0.5 μg/ml recombinant human DLL4 extracellular domain (Cat# 1506-D4-050/CF, R&D Systems) for at least 2 hours. The wells were washed and then blocked with 4% BSA. Following blocking, Fabs H:APF & L6_IGKJ1*01, Fab H:APFF & L6_IGKJ1*01, H:KT & V3-4_IGLJ1*01 and VH1-46_IGHD3-10*01_IGHJ4*01 & L12_IGKJ1*01 at concentrations from 0.004 and 5 μM were added together with recombinant human Fc-Notch extracellular domain (R&D Systems) at a concentration of 10 nM. After incubation for one to two hours, the wells were washed and Notch binding was measured using a mouse anti-human FC-HRP conjugated antibody (Southern Biotech) at an 1:1000 dilution. HRP activity was detected using TMB substrate (Pierce) followed by acid neutralization. The $A_{450}$ was measured on a SpectraMax Plus 384.

Results show that the addition of Fabs H:APF & L6_IGKJ1*01, Fab H:APFF & L6_IGKJ1*01 or H:KT & V3-4_IGLJ1*01 resulted in a decreased signal therefore indicating their ability to block the binding of Notch-Fc to DLL4. The addition of Fab VH1-46_IGHD3-10*01_IGHJ4*01 & L12_IGKJ1*01 did not result an any loss of activity, indicating that Fab VH1-46_IGHD3-10*01_IGHJ4*01 & L12_IGKJ1*01 does not block the Notch-DLL4 interaction. This result also indicates that Fabs H:APF & L6_IGKJ1*01, Fab H:APFF & L6_IGKJ1*01 and H:KT & V3-4_IGLJ1*01 bind different epitopes of DLL4 than Fab VH1-46_IGHD3-10*01_IGHJ4*01 & L12_IGKJ1*01.

Example 11

Inhibition of DLL4-Notch Interaction by Flow Cytometry

In this example, three DLL4 binding Fabs were functionally screened for their ability to block the binding of Notch-Fc to DLL4. In this assay, DLL4-expressing CHO cells were incubated in the presence of both Fab and biotinylated-Notch-Fc. Streptavidin-PE was used as a detection molecule. If Notch-Fc binds to DLL4-expressing CHO cells, these cells will be detected by a PE signal at 578 nm. Alternatively, if the Fab blocks the binding of Notch-Fc to DLL4, the DLL4-expressing CHO cells will not be labeled or detected. The tested Fabs included H:APFF VLTH & L:NDH LS (SEQ ID NOS:239 and 370), H:KT TRV & V3-4_IGLJ1*01 (SEQ ID NOS:433 and 142) and H:KT TRV & L:LP S52G (SEQ ID NOS:433 and 536).

In short, CHO cells expressing full-length DLL4 (CHO-DLL4) as described in Example 8 were detached from tissue culture plates using Accutase™ Enzyme Cell Detachment Medium (Cat# 00-4555-56, eBioscience). Fab was 5-fold serially diluted in 2% BSA/PBS from a starting concentration of 50 nM. Notch-FC (cat# 3647-TK-050, R&D Systems) was biotinylated following using EZ-Link NHS-Biotin Reagent (cat# 20217. Pierce) according to the manufacturers instructions. Detached cells were treated with 250 nM biotinylated Notch-FC in 2% BSA/PBS and 30 µL Fab for 30 minutes on ice. PE-labeled streptavidin (Cat# 21627, Pierce-Thermo Scientific) was then added to a final dilution of 1:5 followed by incubation for 10 minutes at room temperature. The cells were then washed twice in 2% BSA/PBS and analyzed by flow cytometry on a BD FACSAria.

The results are set forth in Table 46 below. All three Fabs effectively block Notch-Fc binding to CHO-DLL4. Fab H:APFF VLTH & L:NDH LS completely blocks the binding of Notch to DLL4 by 80% at a Fab concentration of 2 nM. Fab H:KT TRV & V3-4_IGLJ1*01 blocks the binding of Notch to DLL4 by 50% at a concentration of 50 nM Fab. Fab H:KT TRV & L:LP S52G blocks the binding of Notch to DLL4 by 80% at a concentration of 50 nM Fab.

TABLE 46

Inhibition of DLL4-Notch interaction

| Fab [nM] | H: APFF VLTH & L: NDH LS | H: KT TRV & L: wt | H: KT TRV & L: LP S52G |
|---|---|---|---|
| 50 | 30 | 141 | 105 |
| 10 | 30 | 244 | 190 |
| 2 | 117 | 448 | 250 |
| 0.4 | 277 | Not tested | 324 |
| 0 | 531 | 531 | 531 |

Example 12

IgG Cloning and Expression

In this example, Fab antibodies that bind to DLL4 were converted into IgGs by cloning into the pFUSE vectors. Briefly, sequences encoding heavy and light chains were cloned separately into the pFUSE family of vectors (pFUSE-hIgG2-Fc2, Cat# pfuse-hfc2, InvivoGen) behind the included IL-2 signal sequence. These two vectors were then co-transformed into 293F cells and the protein was expressed and purified.

Light Chain: The Sequence encoding the Fab light chain (excluding the N-terminal *E. coli* sorting signal Met Ala) was amplified by PCR with primers containing EcoRI and NheI ends. The amplified Fab light chain was subcloned into pFUSE-hIgG2-Fc2, previously digested with EcoRI and NheI. The Fab light chain immediately follows the IL-2 signal sequence, and completely replaces the Fc sequence in pFUSE-hIgG2-Fc2.

Heavy Chain: A full-length IgG1 heavy chain sequence with a NheI site between VH and CH1-CH2-CH3 was synthesized by Genscript, amplified by PCR with primers containing EcoRI and XbaI ends, and subcloned into pFUSE-hIgG2-Fc2, previously digested with EcoRI and NheI. Ligation of the XbaI and NheI compatible cohesive ends eliminates both sties at this position, making the NheI site between VH and CH1-CH2-CH3 of the IgG1 heavy chain sequence unique. The sequence encoding Fab heavy chain (excluding the N-terminal *E. coli* sorting signal Met Ala) was amplified by PCR with EcoRI and NheI ends. The vector containing the full length IgG1 heavy chain was then digested with EcoRI and NheI, which removed the VH sequence, and the amplified Fab heavy chain was subcloned into the digested vector. Thus the Fab Heavy chain was subcloned between IL-2 and the IgGI heavy chain.

Protein Expression and Purification: To produce IgG, the heavy and light chain plasmids were co-transfected into 293F cells (Cat# R790-07, Invitrogen) using 293fectin (Cat# 12347, Invitrogen) per manufacturer's instructions. Cells grown in serum-free 293Freestyle media (Cat# 12338026, Invitrogen) were transfected at 1 106 cells/ml in 50 ml spinner flask. Cell culture media were harvested 3 and 6 days after transfection and pooled together for purification by column chromatography using Protein-G Sepharose (GE Healthcare). IgG elution fractions were pooled and dialysed into PBS.

Example 13

Inhibition of DLL4-Notch Interaction by a Reporter Assay

In this example, two DLL4 binding antibodies were assayed for their ability to inhibit DLL4-dependent Notch 1 signaling using a luciferase reporter assay. Reporter cells were generated by stably transfecting human glioma T98G cells, known for the presence of Notch 1 on their cell surface (see Purow et al. (2005) Cancer Res., 65:2353-63), with a Notch reporter plasmid (p6xCBF) containing six C promoter binding factor-1 (CBF-1) responsive elements (set forth in SEQ ID NO:129; see Nefedova et al. (2004), Blood. 103(9): 3503-10). Subsequent addition of DLL4-CHO cells (see Example 8 above) to the reporter T98G cells results in expression of firefly luciferase due to the Notch1-DLL4 interaction. Disruption of the Notch1-DLL4 by a DLL4 binding antibody therefore causes a decrease in luciferase expression.

A. Notch Reporter Plasmids

A reporter construct containing six C promoter binding factor-1 (CBF-1) response elements (set forth in SEQ ID NO:129; CBF Notch-response elements are indicated by bold; ggtacctgagctcgctagcgatctggtg-taaacacgccgtgggaaaaaatttatg-gatctggtgtaaacacgccgtgggaaaaaatttatggagctcgctagcgat ctggt-gtaaacacgccgtgggaaaaaatttatggatctggtgtaaacacgccgt gggaaaaaatttatgctcgaggatctggtgtaaacacgccgtgggaaaaa att-tatggatctggtgtaaacacgccgtgggaaaaaatttatgaagctt;) was digested with KpnI and HindIII. The digested product was then cloned into two different luciferase reporter vectors (pGL4.23 (SEQ ID NO:128; Promega, Catalog # E8411) and pGL4.26 (SEQ ID NO:902; Promega, Catalog # E8441)) at the KpnI and HindIII sites. The pGL4.23 vector requires co-transformation of a *Renilla* luciferase for normalization (see Section B.1 below). The pGL4.26 vector allows for hygromycin selection, which facilitates the production of a cell line with a stably-integrated copy of the reporter (see section B.2 below). Both reporter vectors are suitable for the assay. The use of pGL4.26 eliminates the need need to transiently transfect the reporter and normalize for variable transfection efficiency, as described in Section B.1. below.

B. Assay

T98G cells from ATCC (No. CRL-1690™) were plated onto a 96-well tissue culture plate at 20,000 cells per well in Eagle's Minimum Essential Media (EMEM, Invitrogen) supplemented with 10% Fetal Bovine Serum (BSA, Invitrogen) and 1× penicillin/streptomycin/glutamine (P/S/G, Invitrogen).

1. pGL4.23 p6xCBF Reporter Plasmid

The following day, T98G cells were transfected with the Notch reporter construct expressing Firefly luciferase (p6xCBF) and an internal control construct expressing *Renilla* luciferase (pGL4.75, SEQ ID NO:130; Promega, Catalog #E6931). The transfection was carried out using 0.16 mg of p6xCBF with 0.04 mg of pGL4.75 and 0.5 ml of Lipofectamine 2000 (Invitrogen; Catalog # 11668-027) per well in accordance with manufacturers instructions.

Twenty four hours after transfection, Notch-expressing T98G cells were stimulated by DLL4-expressing CHO cells (as described in Example 8) or control CHO cells. Briefly, media on T98G cells was replaced by 100 ml of serum free F12 media supplemented with P/S/G containing $1 \times 10^6$ cells/ml of the respective CHO cells. Inhibitory Fabs H:APFF VLTH & L:NDH LS (SEQ ID NOS:239 and 370) and H:KT TRV & L:LP S52G (SEQ ID NOS:433 and 536) and control Fab VH1-69_IGHD1-1*01_IGHJ6*01 & A17_IGKJ1*01 (SEQ ID NOS:572 and 573) were added at 100, 20, 4 and 0.8 nM to the cells.

After 24 hours, the reporter readout was assessed using Dual-Glo (Catalog #E2920; Promega, Madison Wis.). The assay system permits a quantitation of both reporters, firefly luciferase and *Renilla* luciferase, thereby allowing for normalization of the expression of an experimental reporter to the expression of a control reporter to differentiate between specific and nonspecific cellular responses. Briefly, media was replaced with a mixture of 75 ml Dual-Glo luciferase buffer and 25 ml PBS per well. After 15 minutes of incubation, firefly luminenscence of the plate was read on a Wallac Victor II model 1420. Next, 25 ml of Dual-Glo Stop & Glo buffer containing 1:100 dilution of Dual-Glo Stop & Glo substrate was added to each well. The plate was incubated for 15 minutes and then *Renilla* luciferase was readout on the Wallac Victor II model 1420 plate reader. Each condition was performed in quadruplicate and data normalized by dividing firefly luminenscence in counts per second (CPS) by *Renilla* luminenscence in CPS.

The results show that cells stimulated just with CHO cells showed a baseline luminescence signal at all doses of Fab antibody tested. Upon stimulation with CHO-DLL4 expressing cells, a high luminescence signal was observed, which remained at a constant high level in the presence of the VH1-69_IGHD1-1*01_IGHJ6*01 & A17_IGKJ1*01 Fab antibody at all concentrations tested. In the presence of the H:APFF VLTH & L:NDH LS Fab, the level of luminescence signal at the 4 nM and 0.8 nM Fab concentrations was similar to that observed in the presence of the VH1-69_IGHD1-1*01_IGHJ6*01 & A17_IGKJ1*01 Fab antibody. In contrast, the luminescence signal observed upon stimulation with CHO-DLL4 cells in the presence of the H:APFF VLTH & L:NDH LS antibody at higher Fab concentrations of 20 nM and 100 nM was decreased, approaching the baseline signal at the 100 nM Fab concentration.

2. pGL4.26 p6xCBF Reporter Plasmid

The following day, T98G cells were transfected with the Notch reporter construct expressing Firefly luciferase (p6xCBF) and stable integrants were selected with 200 ug/ml Hygromycin B (Invitrogen). CHO cells expressing DLL4 or control CHO cells were propagated in F12 media (Invitrogen) supplemented with 10% FBS and P/S/G. Separately, T98G Notch reporter cells (2 $10^5$ cells/well) in EMEM with 10% FBS and P/S/G were plated onto 96-well tissue culture plates. Notch-expressing T98G cells were stimulated by CHO-DLL4 or control CHO cells (1 $10^5$ cells/well). Media on T98G cells was replaced by 100 ml of serum free F12 media supplemented with P/S/G. Fabs H:APFF VLTH & L:NDH LS and H:KT TRV & L:LP S52G and their corresponding IgGs, and control Fab (that does not bind DLL4) were added at 100, 20, 4 and 0.8 nM. After 24 hours, luciferase-reporter expression was measured with Bright-Glo luciferase assay reagent (Cat# E2620, Promega). Luminenscence was read using a Wallac Victor II model 1420 plate reader. Each condition was performed in quadruplicate.

The results show that CHO cells (not expressing DLL4) did not activate Notch reporter alone or in combination with any antibody. Incubation of the T98G reporter cells with CHO-DLL4 resulted in 8- to 9-fold increase in Notch reporter levels compared to those incubated with CHO cells alone. Notch-activation remained constant in the presence of a control Fab that does not bind DLL4. Activation was reduced in the presence of increasing concentrations of anti-DLL4 Fabs H:APFF VLTH & L:NDH LS and H:KT TRV & L:LP S52G. IgG H:APFF VLTH & L:NDH LS (IC50~6 nM), was 30-fold more efficient at disrupting Notch1 binding to DLL4 as compared to Fab H:APFF VLTH & L:NDH LS. IgG H:KT TRV & L:LP S52G was also more efficient at disrupting Notch1 binding to DLL4 as compared to Fab H:KT TRV & L:LP S52G, displaying about 30% reduction in Notch-activation at 0.8 nM. At higher concentrations IgG H:KT TRV & L:LP S52G did not show complete suppression of Notch-activation.

153

Example 14

Inhibition of DLL4/Jag1

In this example, a cellular assay is described in which activation of the Notch pathway prevents C2C12 myoblast cell differentiation (see e.g., Jarriault et al., 1998Molecular and Cellular Biology, 18:7423-7431). In order to activate the Notch pathway, Notch ligands, such as DLL4 or Jag1, must be expressed as full-length proteins on the cell surface. To achieve this Notch activation, non-adherent cells naturally or ectopically expressing Notch ligands DLL4 or Jag1 are co-cultured with C2C12 cells and selected Fabs. Functional inhibition of DLL4 or Jag1 is assessed by the ability of the Fab to promote differentiation, indicating Notch pathway inactivation. The differentiation into tube-like structures is easily discernible morphologically and additionally can be detected with an antibody against troponin t (Sigma-Aldrich).

In short, C2C12 mouse myoblast cells are cultured in the presence and absence of Jag1-expressing IM9 cells (a human lymphoblast cell line) and Fabs. The cells are plated onto glass coverslips in 12 well dishes in DMEM containing 10% FBS (fetal bovine serum). The next day attached C2C12 cells are transferred into DMEM containing 1% FBS to induce differentiation. Following incubation, the cells are visualized to observe whether differentiation into myotubes occurred. Low serum conditions will induce the differentiation of myotubes while Jag1-expressing IM9 cells maintain C2C12 cells in an undifferentiated state in low serum conditions.

Since modifications will be apparent to those of skill in this art, it is intended that this invention be limited only by the scope of the appended claims.

SEQUENCE LISTING (906 sequences)

SEQ ID NO: 1 - DNA, 45 bp, Artificial Sequence
  Description of Artificial Sequence: Synthetic oligonucleotide
  VH5-51_IGHD5-18*01>3_IGHJ4*01 R99A_F
gccatgtattactgtgcgagagccggatacagctatggttacgac

SEQ ID NO: 2 - DNA, 45 bp, Artificial Sequence
  Description of Artificial Sequence: Synthetic oligonucleotide
  VH5-51_IGHD5-18*01>3_IGHJ4*01 R99A_R
gtcgtaaccatagctgtatccggctctcgcacagtaatacatggc

SEQ ID NO: 3 - DNA, 43 bp, Artificial Sequence
  Description of Artificial Sequence: Synthetic oligonucleotide
  VH1-46_IGHD6-6*01_IGHJ1*01 E100A_F
gtgtattactgtgcgagagaggcctatagcagctcgtccgctg

SEQ ID NO: 4 - DNA, 43 bp, Artificial Sequence
  Description of Artificial Sequence: Synthetic oligonucleotide
  VH1-46_IGHD6-6*01_IGHJ1*01 E100A_R
cagcggacgagctgctataggcctctctcgcacagtaatacac

SEQ ID NO: 5 - DNA, 33 bp, Artificial Sequence
  Description of Artificial Sequence: Synthetic oligonucleotide
  EcoRI_F
ttgggcgaattccctagataattaattaggagg

SEQ ID NO: 6 - DNA, 28 bp, Artificial Sequence
  Description of Artificial Sequence: Synthetic oligonucleotide
  FLXhoI_R
ttaaacctcgagccgcggttcattaaag

SEQ ID NO: 7 - DNA, 40 bp, Artificial Sequence
  Description of Artificial Sequence: Synthetic oligonucleotide
  VH5-51_IGHD5-18*01>3_IGHJ4*01 G100_NNK_F
  modified_base (20)..(21): a, c, t or g
gtattactgtgcgagacgtnnktacagctatggttacgac

SEQ ID NO: 8 - DNA, 40 bp, Artificial Sequence
  Description of Artificial Sequence: Synthetic oligonucleotide
  VH5-51_IGHD5-18*01>3_IGHJ4*01 G100_NNK_R
  modified_base (20)..(21): a, c, t or g
gtcgtaaccatagctgtamnnacgtctcgcacagtaatac

SEQ ID NO: 9 - DNA, 35 bp, Artificial Sequence
  Description of Artificial Sequence: Synthetic oligonucleotide
  VH1-46_IGHD6-6*01_IGHJ1*01 S102_NNK_F
  modified_base (17)..(18): a, c, t or g
tgcgagagaggggtatnnkagcagctggtacgact

SEQ ID NO: 10 - DNA, 35 bp, Artificial Sequence
  Description of Artificial Sequence: Synthetic oligonucleotide
  VH1-46_IGHD6-6*01_IGHJ1*01 S102_NNK_R
  modified_base (18)..(19): a, c, t or g
agtcgtaccagctgctmnnatacccctctctcgca

SEQ ID NO: 11 - DNA, 39 bp, Artificial Sequence
  Description of Artificial Sequence: Synthetic oligonucleotide
  VH1-46_IGHD6-6*01_IGHJ1*01 CDR1_F
gagacctactatggttcgggtctctgggtgcgacaggcc

SEQ ID NO: 12 - DNA, 44 bp, Artificial Sequence
  Description of Artificial Sequence: Synthetic oligonucleotide
  VH1-46_IGHD6-6*01_IGHJ1*01 CDR2_F
gagacctactatggttcgggtctcaagttccagggcagagtcac

SEQ ID NO: 13 - DNA, 38 bp, Artificial Sequence
  Description of Artificial Sequence: Synthetic oligonucleotide
  VH1-46_IGHD6-6*01_IGHJ1*01 CDR3_F
gagacctactatggttcgggtctctggggccagggcac

SEQ ID NO: 14 - DNA, 39 bp, Artificial Sequence
  Description of Artificial Sequence: Synthetic oligonucleotide
  VH5-51_IGHD5-18*01>3_IGHJ4*01 CDR1_F
gagacctactatggttcgggtctctgggtgcgccagatg

SEQ ID NO: 15 - DNA, 43 bp, Artificial Sequence
  Description of Artificial Sequence: Synthetic oligonucleotide
  VH5-51_IGHD5-18*01>3_IGHJ4*01 CDR2_F
gagacctactatggttcgggtctccaggtcaccatctcagccg

SEQ ID NO: 16 - DNA, 40 bp, Artificial Sequence
  Description of Artificial Sequence: Synthetic oligonucleotide
  VH5-51_IGHD5-18*01>3_IGHJ4*01 CDR3_F
gagacctactatggttcgggtctctggggccaaggaaccc

SEQ ID NO: 17 - DNA, 45 bp, Artificial Sequence
  Description of Artificial Sequence: Synthetic oligonucleotide
  L6_IGKJ1*01 CDR1_F
gagacctactatggttcgggtctctggtaccaacagaaacctggc

SEQ ID NO: 18 - DNA, 39 bp, Artificial Sequence
  Description of Artificial Sequence: Synthetic oligonucleotide
  L6_IGKJ1*01 CDR2_F
gagacctactatggttcgggtctcggcatcccagccagg

SEQ ID NO: 19 - DNA, 40 bp, Artificial Sequence
  Description of Artificial Sequence: Synthetic oligonucleotide
  L6_IGKJ1*01 CDR3_F
gagacctactatggttcgggtctcttcggccaagggacca

SEQ ID NO: 20 - DNA, 42 bp, Artificial Sequence
  Description of Artificial Sequence: Synthetic oligonucleotide
  V3-4_IGLJ1*01 CDR1_F
gagacctactatggttcgggtctctggtaccagcagacccca

SEQ ID NO: 21 - DNA, 42 bp, Artificial Sequence
  Description of Artificial Sequence: Synthetic oligonucleotide
  V3-4_IGLJ1*01 CDR2_F
gagacctactatggttcgggtctcggggtccctgatcgcttc

SEQ ID NO: 22 - DNA, 42 bp, Artificial Sequence
  Description of Artificial Sequence: Synthetic oligonucleotide
  V3-4_IGLJ1*01 CDR3_F
gagacctactatggttcgggtctcttcggaactgggaccaag

SEQ ID NO: 23 - DNA, 20 bp, Artificial Sequence
  Description of Artificial Sequence: Synthetic oligonucleotide
  Lambda_BSA_F
gagtggagacgaccacaccc

SEQ ID NO: 24 - DNA, 43 bp, Artificial Sequence
  Description of Artificial Sequence: Synthetic oligonucleotide
  VH1-46_IGHD6-6*01_IGHJ1*01 CDR1_R
gagacccgaaccatagtaggtctcagatgccttgcaggaaacc

SEQ ID NO: 25 - DNA, 42 bp, Artificial Sequence
  Description of Artificial Sequence: Synthetic oligonucleotide
  VH1-46_IGHD6-6*01_IGHJ1*01 CDR2_R
gagacccgaaccatagtaggtctctcccatccactcaagccc

SEQ ID NO: 26 - DNA, 45 bp, Artificial Sequence
  Description of Artificial Sequence: Synthetic oligonucleotide
  VH1-46_IGHD6-6*01_IGHJ1*01 CDR3_R
gagacccgaaccatagtaggtctctctcgcacagtaatacacggc

SEQ ID NO: 27 - DNA, 47 bp, Artificial Sequence
  Description of Artificial Sequence: Synthetic oligonucleotide
  VH5-51_IGHD5-18*01>3_IGHJ4*01 CDR1_R
gagacccgaaccatagtaggtctcagaacccttacaggagatcttca

SEQ ID NO: 28 - DNA, 41 bp, Artificial Sequence
  Description of Artificial Sequence: Synthetic oligonucleotide
  VH5-51_IGHD5-18*01>3_IGHJ4*01 CDR2_R
gagacccgaaccatagtaggtctcccccatccactccaggc

SEQ ID NO: 29 - DNA, 45 bp, Artificial Sequence
  Description of Artificial Sequence: Synthetic oligonucleotide
  VH5-51_IGHD5-18*01>3_IGHJ4*01 CDR3_R
gagacccgaaccatagtaggtctctctcgcacagtaatacatggc

SEQ ID NO: 30 - DNA, 41 bp, Artificial Sequence
  Description of Artificial Sequence: Synthetic oligonucleotide
  L6_IGKJ1*01 CDR1_R
gagacccgaaccatagtaggtctcgcaggagagggtggctc

SEQ ID NO: 31 - DNA, 44 bp, Artificial Sequence
  Description of Artificial Sequence: Synthetic oligonucleotide
  L6_IGKJ1*01 CDR2_R
gagacccgaaccatagtaggtctcatagatgaggagcctgggag

SEQ ID NO: 32 - DNA, 50 bp, Artificial Sequence
  Description of Artificial Sequence: Synthetic oligonucleotide
  L6_IGKJ1*01 CDR3_R
gagacccgaaccatagtaggtctcacagtaataaactgcaaaatcttcag

SEQ ID NO: 33 - DNA, 46 bp, Artificial Sequence
  Description of Artificial Sequence: Synthetic oligonucleotide
  V3-4_IGLJ1*01 CDR1_R
gagacccgaaccatagtaggtctcacaagtgagtgtgactgtccct

SEQ ID NO: 34 - DNA, 42 bp, Artificial Sequence
  Description of Artificial Sequence: Synthetic oligonucleotide
  V3-4_IGLJ1*01 CDR2_R
gagacccgaaccatagtaggtctcgtagatgagcgtgcgtgg

SEQ ID NO: 35 - DNA, 51 bp, Artificial Sequence
  Description of Artificial Sequence: Synthetic oligonucleotide
  V3-4_IGLJ1*01 CDR3_R
gagacccgaaccatagtaggtctcacagtaataatcagattcatcatctgc

SEQ ID NO: 36 - DNA, 45 bp, Artificial Sequence
  Description of Artificial Sequence: Synthetic oligonucleotide
  A_ILPTH_F
tgggaataattctccctactggtcatagcacaagctacgcacaga

SEQ ID NO: 37 - DNA, 45 bp, Artificial Sequence
  Description of Artificial Sequence: Synthetic oligonucleotide
  A_VLPTH_F
tgggaatagtgctccctactggtcatagcacaagctacgcacaga

SEQ ID NO: 38 - DNA, 45 bp, Artificial Sequence
  Description of Artificial Sequence: Synthetic oligonucleotide
  A_ALPTH_F
tgggaatagctctccctactggtcatagcacaagctacgcacaga

SEQ ID NO: 39 - DNA, 45 bp, Artificial Sequence
  Description of Artificial Sequence: Synthetic oligonucleotide
  A_GLPTH_F
tgggaataggcctccctactggtcatagcacaagctacgcacaga

SEQ ID NO: 40 - DNA, 45 bp, Artificial Sequence
  Description of Artificial Sequence: Synthetic oligonucleotide
  A_TLPTH_F
tgggaataaccctccctactggtcatagcacaagctacgcacaga

SEQ ID NO: 41 - DNA, 45 bp, Artificial Sequence
  Description of Artificial Sequence: Synthetic oligonucleotide
  A_SLPTH_F
tgggaatatccctccctactggtcatagcacaagctacgcacaga

SEQ ID NO: 42 - DNA, 45 bp, Artificial Sequence
  Description of Artificial Sequence: Synthetic oligonucleotide
  A_YLPTH_F
tgggaatatacctccctactggtcatagcacaagctacgcacaga

SEQ ID NO: 43 - DNA, 45 bp, Artificial Sequence
  Description of Artificial Sequence: Synthetic oligonucleotide
  A_WLPTH_F
tgggaatatggctccctactggtcatagcacaagctacgcacaga

SEQ ID NO: 44 - DNA, 45 bp, Artificial Sequence
  Description of Artificial Sequence: Synthetic oligonucleotide
  A_HLPTH_F
tgggaatacacctccctactggtcatagcacaagctacgcacaga

SEQ ID NO: 45 - DNA, 45 bp, Artificial Sequence
  Description of Artificial Sequence: Synthetic oligonucleotide
  A_RLPTH_F
tgggaatacgcctccctactggtcatagcacaagctacgcacaga

SEQ ID NO: 46 - DNA, 45 bp, Artificial Sequence
  Description of Artificial Sequence: Synthetic oligonucleotide
  A_ELPTH_F
tgggaatagaactccctactggtcatagcacaagctacgcacaga

SEQ ID NO: 47 - DNA, 45 bp, Artificial Sequence
  Description of Artificial Sequence: Synthetic oligonucleotide
  A_NLPTH_F
tgggaataaacctccctactggtcatagcacaagctacgcacaga

SEQ ID NO: 48 - DNA, 45 bp, Artificial Sequence
  Description of Artificial Sequence: Synthetic oligonucleotide
  A_TLVTH_F
tgggaataaccctcgtgactggtcatagcacaagctacgcacaga

SEQ ID NO: 49 - DNA, 45 bp, Artificial Sequence
  Description of Artificial Sequence: Synthetic oligonucleotide
  A_TLATH_F
tgggaataaccctcgctactggtcatagcacaagctacgcacaga

SEQ ID NO: 50 - DNA, 45 bp, Artificial Sequence
  Description of Artificial Sequence: Synthetic oligonucleotide
  A_TLGTH_F
tgggaataaccctcggcactggtcatagcacaagctacgcacaga

SEQ ID NO: 51 - DNA, 45 bp, Artificial Sequence
  Description of Artificial Sequence: Synthetic oligonucleotide
  A_TLTTH_F
tgggaataaccctcaccactggtcatagcacaagctacgcacaga

SEQ ID NO: 52 - DNA, 45 bp, Artificial Sequence
  Description of Artificial Sequence: Synthetic oligonucleotide
  A_TLSTH_F
tgggaataaccctctccactggtcatagcacaagctacgcacaga

SEQ ID NO: 53 - DNA, 45 bp, Artificial Sequence
  Description of Artificial Sequence: Synthetic oligonucleotide
  A_TLYTH_F
tgggaataaccctctacactggtcatagcacaagctacgcacaga

SEQ ID NO: 54 - DNA, 45 bp, Artificial Sequence
  Description of Artificial Sequence: Synthetic oligonucleotide
  A_TLWTH_F
tgggaataaccctctggactggtcatagcacaagctacgcacaga

SEQ ID NO: 55 - DNA, 45 bp, Artificial Sequence
  Description of Artificial Sequence: Synthetic oligonucleotide
  A_TLHTH_F
tgggaataaccctccacactggtcatagcacaagctacgcacaga

SEQ ID NO: 56 - DNA, 45 bp, Artificial Sequence
  Description of Artificial Sequence: Synthetic oligonucleotide
  A_TLRTH_F
tgggaataaccctccgcactggtcatagcacaagctacgcacaga

SEQ ID NO: 57 - DNA, 45 bp, Artificial Sequence
  Description of Artificial Sequence: Synthetic oligonucleotide
  A_TLETH_F
tgggaataaccctcgaaactggtcatagcacaagctacgcacaga

SEQ ID NO: 58 - DNA, 45 bp, Artificial Sequence; identical to SEQ ID NO: 50
  Description of Artificial Sequence: Synthetic oligonucleotide
  A_TLNTH_F

SEQ ID NO: 59 - DNA, 45 bp, Artificial Sequence
  Description of Artificial Sequence: Synthetic oligonucleotide
  A_TLMTH_F
tgggaataaccctcatgactggtcatagcacaagctacgcacaga

SEQ ID NO: 60 - DNA, 45 bp, Artificial Sequence
  Description of Artificial Sequence: Synthetic oligonucleotide
  A_ILPTH_R
aacttctgtgcgtagcttgtgctatgaccagtagggagaattatt

SEQ ID NO: 61 - DNA, 45 bp, Artificial Sequence
  Description of Artificial Sequence: Synthetic oligonucleotide
  A_VLPTH_R
aacttctgtgcgtagcttgtgctatgaccagtagggagcactatt

SEQ ID NO: 62 - DNA, 45 bp, Artificial Sequence
  Description of Artificial Sequence: Synthetic oligonucleotide
  A_ALPTH_R
aacttctgtgcgtagcttgtgctatgaccagtagggagagctatt

SEQ ID NO: 63 - DNA, 45 bp, Artificial Sequence
  Description of Artificial Sequence: Synthetic oligonucleotide
  A_GLPTH_R
aacttctgtgcgtagcttgtgctatgaccagtagggaggcctatt

SEQ ID NO: 64 - DNA, 45 bp, Artificial Sequence
  Description of Artificial Sequence: Synthetic oligonucleotide
  A_TLPTH_R
aacttctgtgcgtagcttgtgctatgaccagtagggagggttatt

SEQ ID NO: 65 - DNA, 45 bp, Artificial Sequence
  Description of Artificial Sequence: Synthetic oligonucleotide
  A_SLPTH_R
aacttctgtgcgtagcttgtgctatgaccagtagggagggatatt

SEQ ID NO: 66 - DNA, 45 bp, Artificial Sequence
  Description of Artificial Sequence: Synthetic oligonucleotide
  A_YLPTH_R
aacttctgtgcgtagcttgtgctatgaccagtagggaggtatatt

SEQ ID NO: 67 - DNA, 45 bp, Artificial Sequence
  Description of Artificial Sequence: Synthetic oligonucleotide
  A_WLPTH_R
aacttctgtgcgtagcttgtgctatgaccagtagggagccatatt

SEQ ID NO: 68 - DNA, 45 bp, Artificial Sequence
  Description of Artificial Sequence: Synthetic oligonucleotide
  A_HLPTH_R
aacttctgtgcgtagcttgtgctatgaccagtagggaggtgtatt

SEQ ID NO: 69 - DNA, 45 bp, Artificial Sequence
  Description of Artificial Sequence: Synthetic oligonucleotide
  A_RLPTH_R
aacttctgtgcgtagcttgtgctatgaccagtagggaggcgtatt

SEQ ID NO: 70 - DNA, 45 bp, Artificial Sequence
  Description of Artificial Sequence: Synthetic oligonucleotide
  A_ELPTH_R
aacttctgtgcgtagcttgtgctatgaccagtagggagttctatt

SEQ ID NO: 71 - DNA, 45 bp, Artificial Sequence
  Description of Artificial Sequence: Synthetic oligonucleotide
  A_NLPTH_R
aacttctgtgcgtagcttgtgctatgaccagtagggaggtttatt

SEQ ID NO: 72 - DNA, 45 bp, Artificial Sequence
  Description of Artificial Sequence: Synthetic oligonucleotide
  A_TLVTH_R
aacttctgtgcgtagcttgtgctatgaccagtcacgagggttatt

SEQ ID NO: 73 - DNA, 45 bp, Artificial Sequence
  Description of Artificial Sequence: Synthetic oligonucleotide
  A_TLATH_R
aacttctgtgcgtagcttgtgctatgaccagtagcgagggttatt

SEQ ID NO: 74 - DNA, 45 bp, Artificial Sequence
  Description of Artificial Sequence: Synthetic oligonucleotide
  A_TLGTH_R
aacttctgtgcgtagcttgtgctatgaccagtgccgagggttatt

SEQ ID NO: 75 - DNA, 45 bp, Artificial Sequence
  Description of Artificial Sequence: Synthetic oligonucleotide
  A_TLTTH_R
aacttctgtgcgtagcttgtgctatgaccagtggtgagggttatt

SEQ ID NO: 76 - DNA, 45 bp, Artificial Sequence
  Description of Artificial Sequence: Synthetic oligonucleotide
  A_TLSTH_R
aacttctgtgcgtagcttgtgctatgaccagtggagagggttatt

SEQ ID NO: 77 - DNA, 45 bp, Artificial Sequence
  Description of Artificial Sequence: Synthetic oligonucleotide
  A_TLYTH_R
aacttctgtgcgtagcttgtgctatgaccagtgtagagggttatt

SEQ ID NO: 78 - DNA, 45 bp, Artificial Sequence
  Description of Artificial Sequence: Synthetic oligonucleotide
  A_TLWTH_R
aacttctgtgcgtagcttgtgctatgaccagtccagagggttatt

SEQ ID NO: 79 - DNA, 45 bp, Artificial Sequence
  Description of Artificial Sequence: Synthetic oligonucleotide
  A_TLHTH_R
aacttctgtgcgtagcttgtgctatgaccagtgtggagggttatt

SEQ ID NO: 80 - DNA, 45 bp, Artificial Sequence
  Description of Artificial Sequence: Synthetic oligonucleotide
  A_TLRTH_R
aacttctgtgcgtagcttgtgctatgaccagtgcggagggttatt

SEQ ID NO: 81 - DNA, 45 bp, Artificial Sequence
  Description of Artificial Sequence: Synthetic oligonucleotide
  A_TLETH_R
aacttctgtgcgtagcttgtgctatgaccagtttcgagggttatt

SEQ ID NO: 82 - DNA, 45 bp, Artificial Sequence; identical to SEQ ID NO: 74
  Description of Artificial Sequence: Synthetic oligonucleotide
  A_TLNTH_R

SEQ ID NO: 83 - DNA, 45 bp, Artificial Sequence
  Description of Artificial Sequence: Synthetic oligonucleotide
  A_TLMTH_R
aacttctgtgcgtagcttgtgctatgaccagtcatgagggttatt

SEQ ID NO: 84 - DNA, 5476 bp, Artificial Sequence
  Description of Artificial Sequence: Synthetic polynucleotide
  Plasmid A (heavy chain with Flag-H6 tag)
catgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgtcccgggtctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagcagatcaattcgcgcgcgaaggcgaagcggcatgcataatgtgcctgtcaaatggacgaagcagggattctgcaaaccctatgctactccgtcaagccgtcaattgtctgattcgttaccaattatgacaacttgacggctacatcattcactttttcttcacaaccggcacggaactcgctcgggctggccccggtgcattttttaaatacccgcgagaaatagagttgatcgtcaaaaccaacattgcgaccgacggtggcgataggcatccgggtggtgctcaaaagcagcttcgcctggctgatacgttggtcctcgcgccagcttaagacgctaatccctaactgctggcggaaaagatgtgacagacgcgacggcgacaagcaaacatgctgtgcgacgctggcgatatcaaaattgctgtctgccaggtgatcgctgatgtactgacaagcctcgcgtacccgattatccatcggtggatggagcgactcgttaatcgcttccatgcgccgcagtaacaattgctcaagcagatttatcgccagcagctccgaatagcgcccttccccttgcccggcgttaatgatttgcccaaacaggtcgctgaaatgcggctggtgcgcttcatccgggcgaaagaaccccgtattggcaaatattgacggccagttaagccattcatgccagtaggcgcgcggacgaaagtaaacccactggtgataccattcgcgagcctccggatgacgaccgtagtgatgaatctctcctggcgggaacagcaaaatatcacccggtcggcaaacaaattctcgtccctgatttttcaccaccccctgaccgcgaatggtgagattgagaatataacctttcattcccagcggtcggtcgataaaaaaatcgagataaccgttggcctcaatcggcgttaaacccgccaccagatgggcattaaacgagtatcccggcagcaggggatcattttgcgcttcagccatacttttcatactcccgccattcagagaagaaaccaattgtccatattgcatcagacattgccgtcactgcgtcttttactggctcttctcgctaaccaaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgttttttgggcgaattccctaggtaattaattaggaggaatttaaaatgaaaaagaatatcgcatttcttcttgcatctatgttcgttttttcaattgctacgaacgccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaagagtattactatggttcggggagttattataacgactactttgactactggggccaaggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaagacgtcgattacaaggatgacgacgataagcatcatcaccatcaccattaattaattaagcggccgctcccacagccgccagttccgctggcggcattttaactttctttaatgaaccgcggctcgagcatgcatctagagggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctatacgtacggcagtttaaggtttacacctataaaagagagagccgttatcgtctgtttgtggatgtacagagtgatattattgacacgccggggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaattttaacaaaattcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgagtcacgacgagatcctcgccgtcgggcatgctcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcttgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatcctcatcctgtctcttgatcagagcttgatcccctgcgccatcagatccttggcggcgagaaagccatccagtttactttgcagggcttcccaaccttaccagagggcgccccagctggcaattccggttcgcttgctgtccataaaaccgcccagtctagctatcgccatgtaagcccactgcaagctacctgctttctctttgcgcttgcgttttcccttgtccagatagcccagtagctgacattcatccggggtcagcaccgtttctgcggactggctttctacgtgaaaaggatctaggtgaagatcctttttgataatct

SEQ ID NO: 85 - DNA, 5491 bp, Artificial Sequence
  Description of Artificial Sequence: Synthetic polynucleotide
  Plasmid D (heavy chain with Flag-LPETG-H6 tag)
catgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgtcccgggtctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagcagatcaattcgcgcgcgaaggcgaagcggcatgcataatgtgcctgtcaaatggacgaagcagggattctgcaaaccctatgctactccgtcaagccgtcaattgtctgattcgttaccaattatgacaacttgacggctacatcattcactttttcttcacaaccggcacggaactcgctcgggctggccccggtgcattttttaaatacccgcgagaaatagagttgatcgtcaaaaccaacattgcgaccgacggtggcgataggcatccgggtggtgctcaaaagcagcttcgcctggctgatacgttggtcctcgcgccagcttaagacgctaatccctaactgctggcggaaaagatgtgacagacgcgacggcgacaagcaaacatgctgtgcgacgctggcgatatcaaaattgctgtctgccaggtgatcgctgatgtactgacaagcctcgcgtacccgattatccatcggtggatggagcgactcgttaatcgcttccatgcgccgcagtaacaattgctcaagcagatttatcgccagcagctccgaatagcgcccttccccttgcccggcgttaatgatttgcccaaacaggtcgctgaaatgcggctggtgcgcttcatccgggcgaaagaaccccgtattggcaaatattgacggccagttaagccattcatgccagtaggcgcgcggacgaaagtaaacccactggtgataccattcgcgagcctccggatgacgaccgtagtgatgaatctctcctggcgggaacagcaaaatatcacccggtcggcaaacaaattctcgtccctgatttttcaccaccccctgaccgcgaatggtgagattgagaatataacctttcattcccagcggtcggtcgataaaaaaatcgagataaccgttggcctcaatcggcgttaaacccgccaccagatgggcattaaacgagtatcccggcagcaggggatcattttgcgcttcagccatacttttcatactcccgccattcagagaagaaaccaattgtccatattgcatcagacattgccgtcactgcgtcttttactggctcttctcgctaaccaaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgttttttgggcgaattccctaggtaattaattaggaggaatttaaaatgaaaaagaatatcgcatttcttcttgcatctatgttcgttttttcaattgctacgaacgccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaagagtattactatggttcggggagttattataacgactactttgactactggggccaaggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaagacgtcgattacaaggatgacgacgataagcttccggaaaccggtcatcatcaccatcaccattaattaattaagcggccgctcccacagccgccagttccgctggcggcattttaactttctttaatgaaccgcggctcgagcatgcatctagagggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctatacgtacggcagtttaaggtttacacctataaaagagagagccgttatcgtctgtttgtggatgtacagagtgatattattgacacgccggggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaattttaacaaaattcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgagtcacgacgagatcctcgccgtcgggcatgctcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcttgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatcctcatcctgtctcttgatcagagcttgatcccctgcgccatcagatccttggcggcgagaaagccatccagtttactttgcagggcttcccaaccttaccagagggcgccccagctggcaattccggttcgcttgctgtccataaaaccgcccagtctagctatcgccatgtaagcccactgcaagctacctgctttctctttgcgcttgcgttttcccttgtccagatagcccagtagctgacattcatccggggtcagcaccgtttctgcggactggctttctacgtgaaaaggatctaggtgaagatcctttttgataatct

SEQ ID NO: 86 - DNA, 4980 bp, Artificial Sequence
  Description of Artificial Sequence: Synthetic polynucleotide
  Plasmid C (for kappa light chain)
catgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgtccgggtctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagcagatcaattcgcgcgcgaaggcgaagcggcatgcataatgtgcctgtcaaatggacgaagcagggattctgcaaaccctatgctactccgtcaagccgtcaattgtctgattcgttaccaattatgacaacttgacggctacatcattcactttttcttcacaaccggcacggaactcgctcgggctggccccggtgcattttttaaatacccgcgagaaatagagttgatcgtcaaaaccaacattgcgaccgacggtggcgataggcatccgggtggtgctcaaaagcagcttcgcctggctgatacgttggtcctcgcgccagcttaagacgctaatccctaactgctggcggaaaagatgtgacagacgcgacggcgacaagcaaacatgctgtgcgacgctggcgatatcaaaattgctgtctgccaggtgatcgctgatgtactgacaagcctcgcgtacccgattatccatcggtggatggagcgactcgttaatcgcttccatgcgccgcagtaacaattgctcaagcagatttatcgccagcagctccgaatagcgcccttccccttgcccggcgttaatgatttgcccaaacaggtcgctgaaatgcggctggtgcgcttcatccgggcgaaagaaccccgtattggcaaatattgacggccagttaagccattcatgccagtaggcgcgcggacgaaagtaaacccactggtgataccattcgcgagcctccggatgacgaccgtagtgatgaatctctcctggcgggaacagcaaaatatcacccggtcggcaaacaaattctcgtccctgatttttcaccaccccctgaccgcgaatggtgagattgagaatataacctttcattcccagcggtcggtcgataaaaaaatcgagataaccgttggcctcaatcggcgttaaacccgccaccagatgggcattaaacgagtatcccggcagcaggggatcattttgcgcttcagccatacttttcatactcccgccattcagagaagaaaccaattgtccatattgcatcagacattgccgtcactgcgtcttttactggctcttctcgctaaccaaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgttttttgggcgaattccctaggtaattaattaggaggaatttaaaatgaagaaaaacatcgcctttctgcttgcatcgatgttcgtgttttcgatcgcgaccaacgccatggcggaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacctccgtggacgttcggccaagggaccaaggtggaaatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttaagcggccgctcccacagccgccagttccgctggcggcattttaactttctttaatgaaccgcggctcgagcatgcatctagagggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctatacgtacaaggcctattggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgactagtgcttggattctcaccaataaaaaacgcccggcggcaaccgagcgttctgaacaaatccagatggagttctgaggtcattactggatctatcaacaggagtccaagcgagctcgatatcaaattacgccccgccctgccactcatcgcagtactgttgtaattcattaagcattctgccgacatggaagccatcacagacggcatgatgaacctgaatcgccagcggcatcagcaccttgtcgccttgcgtataatatttgcccatagtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacgaaattccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccgatcaacgtctcattttcgccagatatcgacgtctaagaaaccattattat

SEQ ID NO: 87 - DNA, 4986 bp, Artificial Sequence
  Description of Artificial Sequence: Synthetic polynucleotide
  Plasmid E (for lambda light chain)
catgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgtccgggtctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagcagatcaattcgcgcgcgaaggcgaagcggcatgcataatgtgcctgtcaaatggacgaagcagggattctgcaaaccctatgctactccgtcaagccgtcaattgtctgattcgttaccaattatgacaacttgacggctacatcattcactttttcttcacaaccggcacggaactcgctcgggctggccccggtgcattttttaaatacccgcgagaaatagagttgatcgtcaaaaccaacattgcgaccgacggtggcgataggcatccgggtggtgctcaaaagcagcttcgcctggctgatacgttggtcctcgcgccagcttaagacgctaatccctaactgctggcggaaaagatgtgacagacgcgacggcgacaagcaaacatgctgtgcgacgctggcgatatcaaaattgctgtctgccaggtgatcgctgatgtactgacaagcctcgcgtacccgattatccatcggtggatggagcgactcgttaatcgcttccatgcgccgcagtaacaattgctcaagcagatttatcgccagcagctccgaatagcgcccttccccttgcccggcgttaatgatttgcccaaacaggtcgctgaaatgcggctggtgcgcttcatccgggcgaaagaaccccgtattggcaaatattgacggccagttaagccattcatgccagtaggcgcgcggacgaaagtaaacccactggtgataccattcgcgagcctccggatgacgaccgtagtgatgaatctctcctggcgggaacagcaaaatatcacccggtcggcaaacaaattctcgtccctgatttttcaccaccccctgaccgcgaatggtgagattgagaatataacctttcattcccagcggtcggtcgataaaaaaatcgagataaccgttggcctcaatcggcgttaaacccgccaccagatgggcattaaacgagtatcccggcagcaggggatcattttgcgcttcagccatacttttcatactcccgccattcagagaagaaaccaattgtccatattgcatcagacattgccgtcactgcgtcttttactggctcttctcgctaaccaaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgttttttgggcgaattccctagataattaattaggaggaatttaaaatgaagaaaaacatcgcctttctgcttgcatcgatgttcgtgttttcgatcgcgaccaacgccatggcgcagcttgtgctgactcaatcgccctctgcctctgcctccctgggagcctcggtcaagctcacctgcactctgagcagtgggcacagcagctacgccatcgcatggcatcagcagcagccagagaagggccctcggtacttgatgaagcttaacagtgatggcagccacagcaagggggacggcatccctgatcgcttctcaggctccagctctggggctgagcgctacctcaccatctccagcctccagtctgaggatgaggctgactattactgtcagacctggggcactggcattcattatgtcttcggaactgggaccaaggtcaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttcataagcggccgctcccacagccgccagttccgctggcggcattttaactttctttaatgaaccgcggctcgagcatgcatctagagggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctatacgtacaaggcctattggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgactagtgcttggattctcaccaataaaaaacgcccggcggcaaccgagcgttctgaacaaatccagatggagttctgaggtcattactggatctatcaacaggagtccaagcgagctcgatatcaaattacgccccgccctgccactcatcgcagtactgttgtaattcattaagcattctgccgacatggaagccatcacagacggcatgatgaacctgaatcgccagcggcatcagcaccttgtcgccttgcgtataatatttgcccatagtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacgaaattccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccgatcaacgtctcattttcgccagatatcgacgtctaagaaaccattattat

SEQ ID NO: 88 - DNA, 380 bp, Artificial Sequence
  Description of Artificial Sequence: Synthetic polynucleotide
  VH1-46_IGHD6-6*01_IGHJ1*01
ccatggcacaggtgcagctggtgcagtctggggctgaggtgaagaagcctggggcctcagtgaaggtttcctgcaaggcatctggatacaccttcaccagctactatatgcactgggtgcgacaggcccctggacaagggcttgagtggatgggaataatcaaccctagtggtggtagcacaagctacgcacagaagttccagggcagagtcaccatgaccagggacacgtccacgagcacagtctacatggagctgagcagcctgagatctgaggacacggccgtgtattactgtgcgagagaggagtatagcagctcgtccgctgaatacttccagcactggggccagggcaccctggtcaccgtctcctcagctagc

SEQ ID NO: 89 - DNA, 377 bp, Artificial Sequence
  Description of Artificial Sequence: Synthetic polynucleotide
  VH5-51_IGHD5-18*01>3_IGHJ4*01
ccatggcagaggtgcagctggtgcagtctggagcagaggtgaaaaagcccggggagtctctgaagatctcctgtaagggttctggatacagctttaccagctactggatcggctgggtgcgccagatgcccgggaaaggcctggagtggatggggatcatctatcctggtgactctgataccagatacagcccgtccttccaaggccaggtcaccatctcagccgacaagtccatcagcaccgcctacctgcagtggagcagcctgaaggcctcggacaccgccatgtattactgtgcgagacgtggatacagctatggttacgactactttgactactggggccaaggaaccctggtcaccgtctcctcagctagc

SEQ ID NO: 90 - DNA, 398 bp, Artificial Sequence
  Description of Artificial Sequence: Synthetic polynucleotide
  VH6-1_IGHD3-3*01_IGHJ4*01
ccatggcacaggtacagctgcagcagtcaggtccaggactggtgaagccctcgcagaccctctcactcacctgtgccatctccggggacagtgtctctagcaacagtgctgcttggaactggatcaggcagtccccatcgagaggccttgagtggctgggaaggacatactacaggtccaagtggtataatgattatgcagtatctgtgaaaagtcgaataaccatcaacccagacacatccaagaaccagttctccctgcagctgaactctgtgactcccgaggacacggctgtgtattactgtgcaagagagtattacgatttttggagtggttattataccgactactttgactactggggccaaggaaccctggtcaccgtctcctcagctagc

SEQ ID NO: 91 - DNA, 389 bp, Artificial Sequence
  Description of Artificial Sequence: Synthetic polynucleotide
  VH1-46_IGHD3-10*01_IGHJ4*01
ccatggcacaggtgcagctggtgcagtctggggctgaggtgaagaagcctggggcctcagtgaaggtttcctgcaaggcatctggatacaccttcaccagctactatatgcactgggtgcgacaggcccctggacaagggcttgagtggatgggaataatcaaccctagtggtggtagcacaagctacgcacagaagttccagggcagagtcaccatgaccagggacacgtccacgagcacagtctacatggagctgagcagcctgagatctgaggacacggccgtgtattactgtgcgagagagtattactatggttcggggagttattataacgactactttgactactggggccaaggaaccctggtcaccgtctcctcagctagc

SEQ ID NO: 92 - DNA, 380 bp, Artificial Sequence
  Description of Artificial Sequence: Synthetic polynucleotide
  VH1-46_IGHD6-13*01_IGHJ4*01
ccatggcacaggtgcagctggtgcagtctggggctgaggtgaagaagcctggggcctcagtgaaggtttcctgcaaggcatctggatacaccttcaccagctactatatgcactgggtgcgacaggcccctggacaagggcttgagtggatgggaataatcaaccctagtggtggtagcacaagctacgcacagaagttccagggcagagtcaccatgaccagggacacgtccacgagcacagtctacatggagctgagcagcctgagatctgaggacacggccgtgtattactgtgcgagagaggggtatagcagcagctggtacgactactttgactactggggccaaggaaccctggtcaccgtctcctcagctagc

SEQ ID NO: 93 - DNA, 392 bp, Artificial Sequence
  Description of Artificial Sequence: Synthetic polynucleotide
  VH1-46_IGHD2-15*01_IGHJ2*01
ccatggcacaggtgcagctggtgcagtctggggctgaggtgaagaagcctggggcctcagtgaaggtttcctgcaaggcatctggatacaccttcaccagctactatatgcactgggtgcgacaggcccctggacaagggcttgagtggatgggaataatcaaccctagtggtggtagcacaagctacgcacagaagttccagggcagagtcaccatgaccagggacacgtccacgagcacagtctacatggagctgagcagcctgagatctgaggacacggccgtgtattactgtgcgagagaaggatattgtagtggtggtagctgctactcctactggtacttcgatctctggggccgtggcaccctggtcactgtctcctcagctagc

SEQ ID NO: 94 - DNA, 365 bp, Artificial Sequence
  Description of Artificial Sequence: Synthetic polynucleotide
  VH4-34_IGHD7-27*01_IGHJ4*01
ccatggcacaggtgcagctacagcagtggggcgcaggactgttgaagccttcggagaccctgtccctcacctgcgctgtctatggtgggtccttcagtggttactactggagctggattcgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggctgtgtattactgtgcgagagctaactggggagactactttgactactggggccaaggaaccctggtcaccgtctcctcagctagc

SEQ ID NO: 95 - DNA, 377 bp, Artificial Sequence
  Description of Artificial Sequence: Synthetic polynucleotide
  VH1-3_IGHD4-23*01_IGHJ4*01
ccatggcacaggttcagctggtgcagtctggggctgaggtgaagaagcctggggcctcagtgaaggtttcctgcaaggcttctggatacaccttcactagctatgctatgcattgggtgcgccaggcccccggacaaaggcttgagtggatgggatggagcaacgctggcaatggtaacacaaaatattcacaggagttccagggcagagtcaccattaccagggacacatccgcgagcacagcctacatggagctgagcagcctgagatctgaggacatggctgtgtattactgtgcgagagatgactacggtggtaactccgactactttgactactggggccaaggaaccctggtcaccgtctcctcagctagc

SEQ ID NO: 96 - DNA, 404 bp, Artificial Sequence
  Description of Artificial Sequence: Synthetic polynucleotide
  VH1-8_IGHD2-2*01_IGHJ6*01
ccatggcacaggtgcagctggtgcagtctggggctgaggtgaagaagcctggggcctcagtgaaggtctcctgcaaggcttctggatacaccttcaccagttatgatatcaactgggtgcgacaggccactggacaagggcttgagtggatgggatggatgaaccctaacagtggtaacacaggctatgcacagaagttccagggcagagtcaccatgaccaggaacacctccataagcacagcctacatggagctgagcagcctgagatctgaggacacggccgtgtattactgtgcgagaggaggatattgtagtagtaccagctgctatgccgattactactactactacggtatggacgtctgggggcaagggaccacggtcaccgtctcctcagctagc

SEQ ID NO: 97 - DNA, 395 bp, Artificial Sequence
  Description of Artificial Sequence: Synthetic polynucleotide
  VH4-31_IGHD2-15*01_IGHJ2*01
ccatggcacaggtgcagctgcaggagtcgggcccaggactggtgaagccttcacagaccctgtccctcacctgtactgtctctggtggctccatcagcagtggtggttactactggagctggattcgccagcacccagggaagggcctggagtggattgggtacatctattacagtgggagcacctactacaacccgtccctcaagagtcgagttaccatatcagtagacacgtctaagaaccagttctccctgaagctgagctctgtgactgccgcggacacggccgtgtattactgtgcgagagaaggatattgtagtggtggtagctgctactcctactggtacttcgatctctggggccgtggcaccctggtcactgtctcctcagctagc

SEQ ID NO: 98 - DNA, 338 bp, Artificial Sequence
  Description of Artificial Sequence: Synthetic polynucleotide
  L6_IGKJ1*01
ccatggcggaaattgtgttgacacagtctccagccaccctgtctttgtctccaggggaaagagccaccctctcctgcagggccagtcagagtgttagcagctacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcaactggcctccgtggacgttcggccaagggaccaaggtggaaatcaaacgtact

SEQ ID NO: 99 - DNA, 343 bp, Artificial Sequence
  Description of Artificial Sequence: Synthetic polynucleotide
  V3-4_IGLJ1*01
ccatggcgcagactgtggtgacccaggagccatcgttctcagtgtcccctggagggacagtcacactcacttgtggcttgagctctggctcagtctctactagttactaccccagctggtaccagcagaccccaggccaggctccacgcacgctcatctacagcacaaacactcgctcttctggggtccctgatcgcttctctggctccatccttgggaacaaagctgccctcaccatcacgggggcccaggcagatgatgaatctgattattactgtgtgctgtatatgggtagtggcatttcttatgtcttcggaactgggaccaaggtcaccgtcctagg

SEQ ID NO: 100 - DNA, 358 bp, Artificial Sequence
  Description of Artificial Sequence: Synthetic polynucleotide
  V4-3_IGLJ4*01
ccatggcgcagcctgtgctgactcagccaacttccctctcagcatctcctggagcatcagccagactcacctgcaccttgcgcagtggcatcaatcttggtagctacaggatattctggtaccagcagaagccagagagccctccccggtatctcctgagctactactcagactcaagtaagcatcagggctctggagtccccagccgcttctctggctccaaagatgcttcgagcaatgcagggattttagtcatctctgggctccagtctgaggatgaggctgactattactgtatgatttggcacagcagtgcttcttttgtatttggtggaggaacccagctgatcatcctagg

SEQ ID NO: 101 - DNA, 341 bp, Artificial Sequence
  Description of Artificial Sequence: Synthetic polynucleotide
  A27_IGKJ1*01
ccatggcggaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacctccgtggacgttcggccaagggaccaaggtggaaatcaaacgtacg

SEQ ID NO: 102 - DNA, 338 bp, Artificial Sequence
  Description of Artificial Sequence: Synthetic polynucleotide
  L2_IGKJ1*01
ccatggcggaaatagtgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtataataactggcctccgtggacgttcggccaagggaccaaggtggaaatcaaacgtact

SEQ ID NO: 103 - DNA, 338 bp, Artificial Sequence
  Description of Artificial Sequence: Synthetic polynucleotide
  L5_IGKJ1*01
ccatggcggacatccagatgacccagtctccatcttccgtgtctgcatctgtaggagacagagtcaccatcacttgtcgggcgagtcagggtattagcagctggttagcctggtatcagcagaaaccagggaaagcccctaagctcctgatctatgctgcatccagtttgcaaagtggggtcccatcaaggttcagcggcagtggatctgggacagatttcactctcaccatcagcagcctgcagcctgaagattttgcaacttactattgtcaacaggctaacagtttccctccgtggacgttcggccaagggaccaaggtggaaatcaaacgtact

SEQ ID NO: 104 - DNA, 338 bp, Artificial Sequence
  Description of Artificial Sequence: Synthetic polynucleotide
  L12_IGKJ1*01
ccatggcggacatccagatgacccagtctccttccaccctgtctgcatctgtaggagacagagtcaccatcacttgccgggccagtcagagtattagtagctggttggcctggtatcagcagaaaccagggaaagcccctaagctcctgatctatgatgcctccagtttggaaagtggggtcccatcaaggttcagcggcagtggatctgggacagaatttactctcaccatcagcagcctgcagcctgatgattttgcaacttattactgccaacagtataatagttattctccgtggacgttcggccaagggaccaaggtggaaatcaaacgtact

SEQ ID NO: 105 - DNA, 356 bp, Artificial Sequence
  Description of Artificial Sequence: Synthetic polynucleotide
  O1_IGKJ1*01
ccatggcggatattgtgatgacccagactccactctccctgcccgtcacccctggagagccggcctccatctcctgcaggtctagtcagagcctcttggatagtgatgatggaaacacctatttggactggtacctgcagaagccagggcagtctccacagctcctgatctatacgctttcctatcgggcctctggagtcccagacaggttcagtggcagtgggtcaggcactgatttcacactgaaaatcagcagggtggaggctgaggatgttggagtttattactgcatgcaacgtatagagtttccttcgtggacgttcggccaagggaccaaggtggaaatcaaacgtact

SEQ ID NO: 106 - DNA, 343 bp, Artificial Sequence
  Description of Artificial Sequence: Synthetic polynucleotide
  V1-4_IGLJ4*01
ccatggcgcagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgaggtcagtaatcggccctcaggggtttctaatcgcttctctggctccaagtctggcaacacggcctccctgaccatctctgggctccaggctgaggacgaggctgattattactgcagctcatatacaagcagcagcactctctttgtatttggtggaggaacccagctgatcatcctagg

SEQ ID NO: 107 - DNA, 358 bp, Artificial Sequence
  Description of Artificial Sequence: Synthetic polynucleotide
  V4-6_IGLJ4*01
ccatggcgcggcccgtgctgactcagccgccctctctgtctgcatccccgggagcaacagccagactcccctgcaccctgagcagtgacctcagtgttggtggtaaaaacatgttctggtaccagcagaagccagggagctctcccaggttattcctgtatcactactcagactcagacaagcagctgggacctggggtccccagtcgagtctctggctccaaggagacctcaagtaacacagcgtttttgctcatctctgggctccagcctgaggacgaggccgattattactgccaggtgtacgaaagtagtgctaattttgtatttggtggaggaacccagctgatcatcctagg

SEQ ID NO: 108 - DNA, 6 bp, Artificial Sequence
  Description of Artificial Sequence: Synthetic oligonucleotide
  NcoI  Restriction Site
ccatgg

SEQ ID NO: 109 - DNA, 6 bp, Artificial Sequence
  Description of Artificial Sequence: Synthetic oligonucleotide
  NheI Restriction Site
gctagc

SEQ ID NO: 110 - DNA, 6 bp, Artificial Sequence
  Description of Artificial Sequence: Synthetic oligonucleotide
  BsiWI Restriction Site
cgtacg

SEQ ID NO: 111 - DNA, 6 bp, Artificial Sequence
  Description of Artificial Sequence: Synthetic oligonucleotide
  AvrII Restriction Site
cctagg

SEQ ID NO: 112 - DNA, 8 bp, Artificial Sequence
  Description of Artificial Sequence: Synthetic oligonucleotide
  NotI Restriction Site
gcggccgc

SEQ ID NO: 113 - DNA, 2678 bp, Homo sapiens
  hDLL4 cDNA
aggccaaaggggagcagcgtcccgagaggagcgcctcttttcagggaccccgccggctggcggacgcgcgggaaagcggcgtcgcgaacagagccagattgagggcccgcgggtggagagagcgacgcccgaggggatggcggcagcgtcccggagcgcctctggctgggcgctactgctgctggtggcactttggcagcagcgcgcggccggctccggcgtcttccagctgcagctgcaggagttcatcaacgagcgcggcgtactggccagtgggcggccttgcgagcccggctgccggactttcttccgcgtctgccttaagcacttccaggcggtcgtctcgcccggaccctgcaccttcgggaccgtctccacgccggtattgggcaccaactccttcgctgtccgggacgacagtagcggcggggggcgcaaccctctccaactgcccttcaatttcacctggccgggtaccttctcgctcatcatcgaagcttggcacgcgccaggagacgacctgcggccagaggccttgccaccagatgcactcatcagcaagatcgccatccagggctccctagctgtgggtcagaactggttattggatgagcaaaccagcaccctcacaaggctgcgctactcttaccgggtcatctgcagtgacaactactatggagacaactgctcccgcctgtgcaagaagcgcaatgaccacttcggccactatgtgtgccagccagatggcaacttgtcctgcctgcccggttggactggggaatattgccaacagcctatctgtctttcgggctgtcatgaacagaatggctactgcagcaagccagcagagtgcctctgccgcccaggctggcagggccggctgtgtaacgaatgcatcccccacaatggctgtcgccacggcacctgcagcactccctggcaatgtacttgtgatgagggctggggaggcctgttttgtgaccaagatctcaactactgcacccaccactccccatgcaagaatggggcaacgtgctccaacagtgggcagcgaagctacacctgcacctgtcgcccaggctacactggtgtggactgtgagctggagctcagcgagtgtgacagcaacccctgtcgcaatggaggcagctgtaaggaccaggaggatggctaccactgcctgtgtcctccgggctactatggcctgcattgtgaacacagcaccttgagctgcgccgactccccctgcttcaatgggggctcctgccgggagcgcaaccagggggccaactatgcttgtgaatgtccccccaacttcaccggctccaactgcgagaagaaagtggacaggtgcaccagcaacccctgtgccaacgggggacagtgcctgaaccgaggtccaagccgcatgtgccgctgccgtcctggattcacgggcacctactgtgaactccacgtcagcgactgtgcccgtaacccttgcgcccacggtggcacttgccatgacctggagaatgggctcatgtgcacctgccctgccggcttctctggccgacgctgtgaggtgcggacatccatcgatgcctgtgcctcgagtccctgcttcaacagggccacctgctacaccgacctctccacagacacctttgtgtgcaactgcccttatggctttgtgggcagccgctgcgagttccccgtgggcttgccgcccagcttcccctgggtggccgtctcgctgggtgtggggctggcagtgctgctggtactgctgggcatggtggcagtggctgtgcggcagctgcggcttcgacggccggacgacggcagcagggaagccatgaacaacttgtcggacttccagaaggacaacctgattcctgccgcccagcttaaaaacacaaaccagaagaaggagctggaagtggactgtggcctggacaagtccaactgtggcaaacagcaaaaccacacattggactataatctggccccagggcccctggggcgggggaccatgccaggaaagtttccccacagtgacaagagcttaggagagaaggcgccactgcggttacacagtgaaaagccagagtgtcggatatcagcgatatgctcccccagggactccatgtaccagtctgtgtgtttgatatcagaggagaggaatgaatgtgtcattgccacggaggtataaggcaggagcctacctggacatccctgctcagccccgcggctggaccttccttctgcattgtttacattgcatcctggatgggacgtttttcatatgcaacgtgctgctctcaggaggaggagggaatggcaggaaccggacagactgtgaacttgccaagagatgcaatacccttccacacctttgggtgtctgtctggcatcagattggcagctgcaccaaccagaggaacagaagagaagagagatgccactgggcactgccctgccagtagtggccttcagggggctccttccggggctccggcctgttttccagagagagtggcagtagccccatggggcccggagctgctgtggcctccactggcatccgtgtttccaaaagtgcctttggcccaggctccacggcgacagttgggcccaaatcagaaaggagagagggggccaatgagggcagggcctcctgtgggctggaaaaccac

SEQ ID NO: 114 - protein, 685 aa, Homo sapiens
  hDLL4
MAAASRSASGWALLLLVALWQQRAAGSGVFQLQLQEFINERGVLASGRPCEPGCRTFFRVCLKHFQAVVSPGPCTFGTVSTPVLGTNSFAVRDDSSGGGRNPLQLPFNFTWPGTFSLIIEAWHAPGDDLRPEALPPDALISKIAIQGSLAVGQNWLLDEQTSTLTRLRYSYRVICSDNYYGDNCSRLCKKRNDHFGHYVCQPDGNLSCLPGWTGEYCQQPICLSGCHEQNGYCSKPAECLCRPGWQGRLCNECIPHNGCRHGTCSTPWQCTCDEGWGGLFCDQDLNYCTHHSPCKNGATCSNSGQRSYTCTCRPGYTGVDCELELSECDSNPCRNGGSCKDQEDGYHCLCPPGYYGLHCEHSTLSCADSPCFNGGSCRERNQGANYACECPPNFTGSNCEKKVDRCTSNPCANGGQCLNRGPSRMCRCRPGFTGTYCELHVSDCARNPCAHGGTCHDLENGLMCTCPAGFSGRRCEVRTSIDACASSPCFNRATCYTDLSTDTFVCNCPYGFVGSRCEFPVGLPPSFPWVAVSLGVGLAVLLVLLGMVAVAVRQLRLRRPDDGSREAMNNLSDFQKDNLIPAAQLKNTNQKKELEVDCGLDKSNCGKQQNHTLDYNLAPGPLGRGTMPGKFPHSDKSLGEKAPLRLHSEKPECRISAICSPRDSMYQSVCLISEERNECVIATEV

SEQ ID NO: 115 - protein, 686 aa, Mus musculus
  mDLL4
MTPASRSACRWALLLLAVLWPQQRAAGSGIFQLRLQEFVNQRGMLANGQSCEPGCRTFFRICLKHFQATFSEGPCTFGNVSTPVLGTNSFVVRDKNSGSGRNPLQLPFNFTWPGTFSLNIQAWHTPGDDLRPETSPGNSLISQIIIQGSLAVGKIWRTDEQNDTLTRLSYSYRVICSDNYYGESCSRLCKKRDDHFGHYECQPDGSLSCLPGWTGKYCDQPICLSGCHEQNGYCSKPDECICRPGWQGRLCNECIPHNGCRHGTCSIPWQCACDEGWGGLFCDQDLNYCTHHSPCKNGSTCSNSGPKGYTCTCLPGYTGEHCELGLSKCASNPCRNGGSCKDQENSYHCLCPPGYYGQHCEHSTLTCADSPCFNGGSCRERNQGSSYACECPPNFTGSNCEKKVDRCTSNPCANGGQCLNRGPSRTCRCRPGFTGTHCELHISDCARSPCAHGGTCHDLENGPVCTCPAGFSGRRCEVRITHDACASGPCFNGATCYTGLSPNNFVCNCPYGFVGSRCEFPVGLPPSFPWVAVSLGVGLVVLLVLLVMVVVAVRQLRLRRPDDESREAMNNLSDFQKDNLIPAAQLKNTNQKKELEVDCGLDKSNCGKLQNHTLDYNLAPGLLGRGSMPGKYPHSDKSLGEKVPLRLHSEKPECRISAICSPRDSMYQSVCLISEERNECVIATEV

SEQ ID NO: 116 - DNA, 3519 bp, Artificial Sequence
  Description of Artificial Sequence: Synthetic polynucleotide
  pCR-BluntII TOPO plasmid
agcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctatttaggtgacactatagaatactcaagctatgcatcaagcttggtaccgagctcggatccactagtaacggccgccagtgtgctggaattcgcccttaagggcgaattctgcagatatccatcacactggcggccgctcgagcatgcatctagagggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctatacgtacggcagtttaaggtttacacctataaaagagagagccgttatcgtctgtttgtggatgtacagagtgatattattgacacgccggggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggcatgagattatcaaaaaggatcttcacctagatccttttcacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttctcgccgccaaggatctgatggcgcaggggatcaagctctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaagacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgagcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattattaacgcttacaatttcctgatgcggtattttctccttacgcatctgtgcggtatttcacaccgcatacaggtggcacttttcggggaaatgtgcgcggaacccctatttgtttatttttctaaatacattcaaatatgtatccgctcatgagacaataaccctgataaatgcttcaataatagcacgtgaggagggccaccatggccaagttgaccagtgccgttccggtgctcaccgcgcgcgacgtcgccggagcggtcgagttctggaccgaccggctcgggttctcccgggacttcgtggaggacgacttcgccggtgtggtccgggacgacgtgaccctgttcatcagcgcggtccaggaccaggtggtgccggacaacaccctggcctgggtgtgggtgcgcggcctggacgagctgtacgccgagtggtcggaggtcgtgtccacgaacttccgggacgcctccgggccggccatgaccgagatcggcgagcagccgtgggggcgggagttcgccctgcgcgacccggccggcaactgcgtgcacttcgtggccgaggagcaggactgacacgtgctaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctgggcttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaag

SEQ ID NO: 117 - DNA, 5070 bp, Artificial Sequence
  Description of Artificial Sequence: Synthetic polynucleotide
  pcDNA5/FRT
gacggatcgggagatctcccgatcccctatggtgcactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagctggctagcgtttaaacttaagcttggtaccgagctcggatccactagtccagtgtggtggaattctgcagatatccagcacagtggcggccgctcgagtctagagggcccgtttaaacccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtacctagaagttcctattccgaagttcctattctctagaaagtataggaacttccttggccaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagcacgtactacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtc

SEQ ID NO: 118 - DNA, 5785 bp, Artificial Sequence
  Description of Artificial Sequence: Synthetic polynucleotide
  pOG44
ccgcggtctttcggacttttgaaagtgatggtggtgggggaaggattcgaaccttcgaagtcgatgacggcagatttagagtctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagcttctagaattcgctgtctgcgagggccagctgttggggtgagtactccctctcaaaagcgggcatgacttctgcgctaagattgtcagtttccaaaaacgaggaggatttgatattcacctggcccgcggtgatgcctttgagggtggccgcgtccatctggtcagaaaagacaatctttttgttgtcaagcttgaggtgtggcaggcttgagatctggccatacacttgagtgacaatgacatccactttgcctttctctccacaggtgtccactcccaggtccaactgcagcccaagcttccaccatgccacaatttgatatattatgtaaaacaccacctaaggtgcttgttcgtcagtttgtggaaaggtttgaaagaccttcaggtgagaaaatagcattatgtgctgctgaactaacctatttatgttggatgattacacataacggaacagcaatcaagagagccacattcatgagctataatactatcataagcaattcgctgagtttggatattgtcaacaagtcactgcagtttaaatacaagacgcaaaaagcaacaattctggaagcctcattaaagaaattgattcctgcttgggaatttacaattattccttactatggacaaaaacatcaatctgatatcactgatattgtaagtagtttgcaattacagttcgaatcatcggaagaagcagataagggaaatagccacagtaaaaaaatgcttaaagcacttctaagtgagggtgaaagcatctgggagatcactgagaaaatactaaattcgtttgagtatacttcgagatttacaaaaacaaaaactttataccaattcctcttcctagctactttcatcaattgtggaagattcagcgatattaagaacgttgatccgaaatcatttaaattagtccaaaataagtatctgggagtaataatccagtgtttagtgacagagacaaagacaagcgttagtaggcacatatacttctttagcgcaaggggtaggatcgatccacttgtatatttggatgaatttttgaggaattctgaaccagtcctaaaacgagtaaataggaccggcaattcttcaagcaacaagcaggaataccaattattaaaagataacttagtcagatcgtacaacaaagctttgaagaaaaatgcgccttattcaatctttgctataaaaaatggcccaaaatctcacattggaagacatttgatgacctcatttctttcaatgaagggcctaacggagttgactaatgttgtgggaaattggagcgataagcgtgcttctgccgtggccaggacaacgtatactcatcagataacagcaatacctgatcactacttcgcactagtttctcggtactatgcatatgatccaatatcaaaggaaatgatagcattgaaggatgagactaatccaattgaggagtggcagcatatagaacagctaaagggtagtgctgaaggaagcatacgataccccgcatggaatgggataatatcacaggaggtactagactacctttcatcctacataaatagacgcatataagtacgcatttaagcataaacacgcactatgccgttcttctcatgtatatatatatacaggcaacacgcagatataggtgcgacgtgaacagtgagctgtatgtgcgggtaccgagctcctcgaggatcagacatgataagatacattgatgagtttggacaaaccacaactagaatgcagtgaaaaaaatgctttatttgtgaaatttgtgatgctattgctttatttgtaaccattataagctgcaataaacaagttatcctcgaggagctcatgagcgcttgtttcggcgtgggtatggtggcaggcccgtggccgggggactgttgggcgccatctccttgcatgcaccattccttgcggcggcggtgctcaacggcctcaacctactactgggctgcttcctaatgcaggagtcgcataagggagagcgtcgacctcgagggggggcccggtacccagcttttgttccctttagtgagggttaattgcgcgcttggcgtaatcatggtcatagctgtttcctgtgtgaaattgttatccgctcacaattccacacaacatacgagccgggagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcttcgggaagcgtggcgctttctcatagctcacgctgtaggtatctcagttcggtgtaggtcgttcgctccaagctgggctgtgtgcacgaaccccccgttcagcccgaccctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttacttcggaaaaagagttggtagctcttgatccggcaaacaaaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccactaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattggagctcca

SEQ ID NO: 119 - DNA, 31 bp, Artificial Sequence
  Description of Artificial Sequence: Synthetic oligonucleotide
  DLL4 ECD forward
tgacctaggctagcatggcggcagcgtcccg

SEQ ID NO: 120 - DNA, 47 bp, Artificial Sequence
  Description of Artificial Sequence: Synthetic oligonucleotide
  DLL4 ECD reverse1
cagatcctcttctgagatgagtttttgttccggcaagcccacgggga

SEQ ID NO: 121 - DNA, 59 bp, Artificial Sequence
  Description of Artificial Sequence: Synthetic oligonucleotide
  DLL4 ECD reverse2
ttactgacgcggccgctcatcaatggtgatggtgatgatgcagatcctcttctgagatg

SEQ ID NO: 122 - DNA, 71 bp, Artificial Sequence
  Description of Artificial Sequence: Synthetic oligonucleotide
  DLL4 pre-DSL reverse1
ttactgacgcggccgctcatcacagatcctcttctgagatgagtttttgttcccggtaagagtagcgcagc

SEQ ID NO: 123 - DNA, 73 bp, Artificial Sequence
  Description of Artificial Sequence: Synthetic oligonucleotide
  DLL4 DSL reverse1
ttactgacgcggccgctcatcacagatcctcttctgagatgagtttttgttcgcaatattccccagtccaacc

SEQ ID NO: 124 - DNA, 71 bp, Artificial Sequence
  Description of Artificial Sequence: Synthetic oligonucleotide
  DLL4 Egf1 reverse1
ttactgacgcggccgctcatcacagatcctcttctgagatgagtttttgttcgttacacagccggccctgc

SEQ ID NO: 125 - DNA, 73 bp, Artificial Sequence
  Description of Artificial Sequence: Synthetic oligonucleotide
  DLL4 Egf4 reverse1
ttactgacgcggccgctcatcacagatcctcttctgagatgagtttttgttcttcacaatgcaggccatagta

SEQ ID NO: 126 - DNA, 71 bp, Artificial Sequence
  Description of Artificial Sequence: Synthetic oligonucleotide
  DLL4 Egf7 reverse1
ttactgacgcggccgctcatcacagatcctcttctgagatgagtttttgttcctcacagcgtcggccagag

SEQ ID NO: 127 - DNA, 259 bp, Artificial Sequence
  Description of Artificial Sequence: Synthetic polynucleotide
  CBF-1
ggtacctgagctcgctagcgatctggtgtaaacacgccgtgggaaaaaatttatggatctggtgtaaacacgccgtgggaaaaaatttatggagctcgctagcgatctggtgtaaacacgccgtgggaaaaaatttatggatctggtgtaaacacgccgtgggaaaaaatttatgctcgaggatctggtgtaaacacgccgtgggaaaaaatttatggatctggtgtaaacacgccgtgggaaaaaatttatgaagctt

SEQ ID NO: 128 - DNA, 4283 bp, Artificial Sequence
  Description of Artificial Sequence: Synthetic polynucleotide
  pGL4.23
ggcctaactggccggtacctgagctcgctagcctcgaggatatcaagatctggcctcggcggccaagcttagacactagagggtatataatggaagctcgacttccagcttggcaatccggtactgttggtaaagccaccatggaagatgccaaaaacattaagaagggcccagcgccattctacccactcgaagacgggaccgccggcgagcagctgcacaaagccatgaagcgctacgccctggtgcccggcaccatcgcctttaccgacgcacatatcgaggtggacattacctacgccgagtacttcgagatgagcgttcggctggcagaagctatgaagcgctatgggctgaatacaaaccatcggatcgtggtgtgcagcgagaatagcttgcagttcttcatgcccgtgttgggtgccctgttcatcggtgtggctgtggccccagctaacgacatctacaacgagcgcgagctgctgaacagcatgggcatcagccagcccaccgtcgtattcgtgagcaagaaagggctgcaaaagatcctcaacgtgcaaaagaagctaccgatcatacaaaagatcatcatcatggatagcaagaccgactaccagggcttccaaagcatgtacaccttcgtgacttcccatttgccacccggcttcaacgagtacgacttcgtgcccgagagcttcgaccgggacaaaaccatcgccctgatcatgaacagtagtggcagtaccggattgcccaagggcgtagccctaccgcaccgcaccgcttgtgtccgattcagtcatgcccgcgaccccatcttcggcaaccagatcatccccgacaccgctatcctcagcgtggtgccatttcaccacggcttcggcatgttcaccacgctgggctacttgatctgcggctttcgggtcgtgctcatgtaccgcttcgaggaggagctattcttgcgcagcttgcaagactataagattcaatctgccctgctggtgcccacactatttagcttcttcgctaagagcactctcatcgacaagtacgacctaagcaacttgcacgagatcgccagcggcggggcgccgctcagcaaggaggtaggtgaggccgtggccaaacgcttccacctaccaggcatccgccagggctacggcctgacagaaacaaccagcgccattctgatcacccccgaaggggacgacaagcctggcgcagtaggcaaggtggtgcccttcttcgaggctaaggtggtggacttggacaccggtaagacactgggtgtgaaccagcgcggcgagctgtgcgtccgtggccccatgatcatgagcggctacgttaacaaccccgaggctacaaacgctctcatcgacaaggacggctggctgcacagcggcgacatcgcctactgggacgaggacgagcacttcttcatcgtggaccggctgaagagcctgatcaaatacaagggctaccaggtagccccagccgaactggagagcatcctgctgcaacaccccaacatcttcgacgccggggtcgccggcctgcccgacgacgatgccggcgagctgcccgccgcagtcgtcgtgctggaacacggtaaaaccatgaccgagaaggagatcgtggactatgtggccagccaggttacaaccgccaagaagctgcgcggtggtgttgtgttcgtggacgaggtgcctaaaggactgaccggcaagttggacgcccgcaagatccgcgagattctcattaaggccaagaagggcggcaagatcgccgtgtaataattctagagtcggggcggccggccgcttcgagcagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtaaaatcgataaggatccgtcgaccgatgcccttgagagccttcaacccagtcagctccttccggtgggcgcggggcatgactatcgtcgccgcacttatgactgtcttctttatcatgcaactcgtaggacaggtgccggcagcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagcggccgcaaatgctaaaccactgcagtggttaccagtgcttgatcagtgaggcaccgatctcagcgatctgcctatttcgttcgtccatagtggcctgactccccgtcgtgtagatcactacgattcgtgagggcttaccatcaggccccagcgcagcaatgatgccgcgagagccgcgttcaccggcccccgatttgtcagcaatgaaccagccagcagggagggccgagcgaagaagtggtcctgctactttgtccgcctccatccagtctatgagctgctgtcgtgatgctagagtaagaagttcgccagtgagtagtttccgaagagttgtggccattgctactggcatcgtggtatcacgctcgtcgttcggtatggcttcgttcaactctggttcccagcggtcaagccgggtcacatgatcacccatattatgaagaaatgcagtcagctccttagggcctccgatcgttgtcagaagtaagttggccgcggtgttgtcgctcatggtaatggcagcactacacaattctcttaccgtcatgccatccgtaagatgcttttccgtgaccggcgagtactcaaccaagtcgttttgtgagtagtgtatacggcgaccaagctgctcttgcccggcgtctatacgggacaacaccgcgccacatagcagtactttgaaagtgctcatcatcgggaatcgttcttcggggcggaaagactcaaggatcttgccgctattgagatccagttcgatatagcccactcttgcacccagttgatcttcagcatcttttactttcaccagcgtttcggggtgtgcaaaaacaggcaagcaaaatgccgcaaagaagggaatgagtgcgacacgaaaatgttggatgctcatactcgtcctttttcaatattattgaagcatttatcagggttactagtacgtctctcaaggataagtaagtaatattaaggtacgggaggtattggacaggccgcaataaaatatctttattttcattacatctgtgtgttggttttttgtgtgaatcgatagtactaacatacgctctccatcaaaacaaaacgaaacaaaacaaactagcaaaataggctgtccccagtgcaagtgcaggtgccagaacatttctct

SEQ ID NO: 129 - DNA, 259 bp, Artificial Sequence; identical to SEQ ID NO: 127
  Description of Artificial Sequence: Synthetic polynucleotide
  P6xCBF

SEQ ID NO: 130 - DNA, 4281 bp, Artificial Sequence
  Description of Artificial Sequence: Synthetic polynucleotide
  pGL4.75
ggcctaactggcctcaatattggccattagccatattattcattggttatatagcataaatcaatattggctattggccattgcatacgttgtatctatatcataatatgtacatttatattggctcatgtccaatatgaccgccatgttggcattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcactagaagctttattgcggtagtttatcacagttaaattgctaacgcagtcagtgggcctcggcggccaagcttggcaatccggtactgttggtaaagccaccatggcttccaaggtgtacgaccccgagcaacgcaaacgcatgatcactgggcctcagtggtgggctcgctgcaagcaaatgaacgtgctggactccttcatcaactactatgattccgagaagcacgccgagaacgccgtgatttttctgcatggtaacgctgcctccagctacctgtggaggcacgtcgtgcctcacatcgagcccgtggctagatgcatcatccctgatctgatcggaatgggtaagtccggcaagagcgggaatggctcatatcgcctcctggatcactacaagtacctcaccgcttggttcgagctgctgaaccttccaaagaaaatcatctttgtgggccacgactggggggcttgtctggcctttcactactcctacgagcaccaagacaagatcaaggccatcgtccatgctgagagtgtcgtggacgtgatcgagtcctgggacgagtggcctgacatcgaggaggatatcgccctgatcaagagcgaagagggcgagaaaatggtgcttgagaataacttcttcgtcgagaccatgctcccaagcaagatcatgcggaaactggagcctgaggagttcgctgcctacctggagccattcaaggagaagggcgaggttagacggcctaccctctcctggcctcgcgagatccctctcgttaagggaggcaagcccgacgtcgtccagattgtccgcaactacaacgcctaccttcgggccagcgacgatctgcctaagatgttcatcgagtccgaccctgggttcttttccaacgctattgtcgagggagctaagaagttccctaacaccgagttcgtgaaggtgaagggcctccacttcagccaggaggacgctccagatgaaatgggtaagtacatcaagagcttcgtggagcgcgtgctgaagaacgagcagtaattctagagtcggggcggccggccgcttcgagcagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtaaaatcgataaggatccgtcgaccgatgcccttgagagccttcaacccagtcagctccttccggtgggcgcggggcatgactatcgtcgccgcacttatgactgtcttctttatcatgcaactcgtaggacaggtgccggcagcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagcggccgcaaatgctaaaccactgcagtggttaccagtgcttgatcagtgaggcaccgatctcagcgatctgcctatttcgttcgtccatagtggcctgactccccgtcgtgtagatcactacgattcgtgagggcttaccatcaggccccagcgcagcaatgatgccgcgagagccgcgttcaccggcccccgatttgtcagcaatgaaccagccagcagggagggccgagcgaagaagtggtcctgctactttgtccgcctccatccagtctatgagctgctgtcgtgatgctagagtaagaagttcgccagtgagtagtttccgaagagttgtggccattgctactggcatcgtggtatcacgctcgtcgttcggtatggcttcgttcaactctggttcccagcggtcaagccgggtcacatgatcacccatattatgaagaaatgcagtcagctccttagggcctccgatcgttgtcagaagtaagttggccgcggtgttgtcgctcatggtaatggcagcactacacaattctcttaccgtcatgccatccgtaagatgcttttccgtgaccggcgagtactcaaccaagtcgttttgtgagtagtgtatacggcgaccaagctgctcttgcccggcgtctatacgggacaacaccgcgccacatagcagtactttgaaagtgctcatcatcgggaatcgttcttcggggcggaaagactcaaggatcttgccgctattgagatccagttcgatatagcccactcttgcacccagttgatcttcagcatcttttactttcaccagcgtttcggggtgtgcaaaaacaggcaagcaaaatgccgcaaagaagggaatgagtgcgacacgaaaatgttggatgctcatactcgtcctttttcaatattattgaagcatttatcagggttactagtacgtctctcaaggataagtaagtaatattaaggtacgggaggtattggacaggccgcaataaaatatctttattttcattacatctgtgtgttggttttttgtgtgaatcgatagtactaacatacgctctccatcaaaacaaaacgaaacaaaacaaactagcaaaataggctgtccccagtgcaagtgcaggtgccagaacatttctct

SEQ ID NO: 131 - protein, 124 aa, Artificial Sequence
  Description of Artificial Sequence: Synthetic polypeptide
  VH1-46_IGHD6-6*01_IGHJ1*01
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCAREEYSSSSAEYFQHWGQGTLVTVSSAS

SEQ ID NO: 132 - protein, 123 aa, Artificial Sequence
  Description of Artificial Sequence: Synthetic polypeptide
  VH5-51_IGHD5-18*01>3_IGHJ4*01
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARRGYSYGYDYFDYWGQGTLVTVSSAS

SEQ ID NO: 133 - protein, 130 aa, Artificial Sequence
  Description of Artificial Sequence: Synthetic polypeptide
  VH6-1_IGHD3-3*01_IGHJ4*01
QVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCAREYYDFWSGYYTDYFDYWGQGTLVTVSSAS

SEQ ID NO: 134 - protein, 127 aa, Artificial Sequence
  Description of Artificial Sequence: Synthetic polypeptide
  VH1-46_IGHD3-10*01_IGHJ4*01
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCAREYYYGSGSYYNDYFDYWGQGTLVTVSSAS

SEQ ID NO: 135 - protein, 124 aa, Artificial Sequence
  Description of Artificial Sequence: Synthetic polypeptide
  VH1-46_IGHD6-13*01_IGHJ4*01
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCAREGYSSSWYDYFDYWGQGTLVTVSSAS

SEQ ID NO: 136 - protein, 128 aa, Artificial Sequence
  Description of Artificial Sequence: Synthetic polypeptide
  VH1-46_IGHD2-15*01_IGHJ2*01
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCAREGYCSGGSCYSYWYFDLWGRGTLVTVSSAS

SEQ ID NO: 137 - protein, 119 aa, Artificial Sequence
  Description of Artificial Sequence: Synthetic polypeptide
  VH4-34_IGHD7-27*01_IGHJ4*01
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARANWGDYFDYWGQGTLVTVSSAS

SEQ ID NO: 138 - protein, 123 aa, Artificial Sequence
  Description of Artificial Sequence: Synthetic polypeptide
  VH1-3_IGHD4-23*01_IGHJ4*01
QVQLVQSGAEVKKPGASVKVSCKASGYTFTSYAMHWVRQAPGQRLEWMGWSNAGNGNTKYSQEFQGRVTITRDTSASTAYMELSSLRSEDMAVYYCARDDYGGNSDYFDYWGQGTLVTVSSAS

SEQ ID NO: 139 - protein, 132 aa, Artificial Sequence
  Description of Artificial Sequence: Synthetic polypeptide
  VH1-8_IGHD2-2*01_IGHJ6*01
QVQLVQSGAEVKKPGASVKVSCKASGYTFTSYDINWVRQATGQGLEWMGWMNPNSGNTGYAQKFQGRVTMTRNTSISTAYMELSSLRSEDTAVYYCARGGYCSSTSCYADYYYYYGMDVWGQGTTVTVSSAS

SEQ ID NO: 140 - protein, 129 aa, Artificial Sequence
  Description of Artificial Sequence: Synthetic polypeptide
  VH4-31_IGHD2-15*01_IGHJ2*01
QVQLQESGPGLVKPSQTLSLTCTVSGGSISSGGYYWSWIRQHPGKGLEWIGYIYYSGSTYYNPSLKSRVTISVDTSKNQFSLKLSSVTAADTAVYYCAREGYCSGGSCYSYWYFDLWGRGTLVTVSSAS

SEQ ID NO: 141 - protein, 110 aa, Artificial Sequence
  Description of Artificial Sequence: Synthetic polypeptide
  L6_IGKJ1*01
EIVLTQSPATLSLSPGERATLSCRASQSVSSYLAWYQQKPGQAPRLLIYDASNRATGIPARFSGSGSGTDFTLTISSLEPEDFAVYYCQQRSNWPPWTFGQGTKVEIKRT

SEQ ID NO: 142 - protein, 111 aa, Artificial Sequence
  Description of Artificial Sequence: Synthetic polypeptide
  V3-4_IGLJ1*01
QTVVTQEPSFSVSPGGTVTLTCGLSSGSVSTSYYPSWYQQTPGQAPRTLIYSTNTRSSGVPDRFSGSILGNKAALTITGAQADDESDYYCVLYMGSGISYVFGTGTKVTVL

SEQ ID NO: 143 - protein, 116 aa, Artificial Sequence
  Description of Artificial Sequence: Synthetic polypeptide
  V4-3_IGLJ4*01
QPVLTQPTSLSASPGASARLTCTLRSGINLGSYRIFWYQQKPESPPRYLLSYYSDSSKHQGSGVPSRFSGSKDASSNAGILVISGLQSEDEADYYCMIWHSSASFVFGGGTQLIIL

SEQ ID NO: 144 - protein, 111 aa, Artificial Sequence
  Description of Artificial Sequence: Synthetic polypeptide
  A27_IGKJ1*01
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPPWTFGQGTKVEIKRT

SEQ ID NO: 145 - protein, 110 aa, Artificial Sequence
  Description of Artificial Sequence: Synthetic polypeptide
  L2_IGKJ1*01
EIVMTQSPATLSVSPGERATLSCRASQSVSSNLAWYQQKPGQAPRLLIYGASTRATGIPARFSGSGSGTEFTLTISSLQSEDFAVYYCQQYNNWPPWTFGQGTKVEIKRT

SEQ ID NO: 146 - protein, 110 aa, Artificial Sequence
  Description of Artificial Sequence: Synthetic polypeptide
  L5_IGKJ1*01
DIQMTQSPSSVSASVGDRVTITCRASQGISSWLAWYQQKPGKAPKLLIYAASSLQSGVPSRFSGSGSGTDFTLTISSLQPEDFATYYCQQANSFPPWTFGQGTKVEIKRT

SEQ ID NO: 147 - protein, 110 aa, Artificial Sequence
  Description of Artificial Sequence: Synthetic polypeptide
  L12_IGKJ1*01
DIQMTQSPSTLSASVGDRVTITCRASQSISSWLAWYQQKPGKAPKLLIYDASSLESGVPSRFSGSGSGTEFTLTISSLQPDDFATYYCQQYNSYSPWTFGQGTKVEIKRT

SEQ ID NO: 148 - protein, 116 aa, Artificial Sequence
  Description of Artificial Sequence: Synthetic polypeptide
  O1_IGKJ1*01
DIVMTQTPLSLPVTPGEPASISCRSSQSLLDSDDGNTYLDWYLQKPGQSPQLLIYTLSYRASGVPDRFSGSGSGTDFTLKISRVEAEDVGVYYCMQRIEFPSWTFGQGTKVEIKRT

SEQ ID NO: 149 - protein, 111 aa, Artificial Sequence
  Description of Artificial Sequence: Synthetic polypeptide
  V1-4_IGLJ4*01
QSALTQPASVSGSPGQSITISCTGTSSDVGGYNYVSWYQQHPGKAPKLMIYEVSNRPSGVSNRFSGSKSGNTASLTISGLQAEDEADYYCSSYTSSSTLFVFGGGTQLIIL

SEQ ID NO: 150 - protein, 116 aa, Artificial Sequence
  Description of Artificial Sequence: Synthetic polypeptide
  V4-6_IGLJ4*01
RPVLTQPPSLSASPGATARLPCTLSSDLSVGGKNMFWYQQKPGSSPRLFLYHYSDSDKQLGPGVPSRVSGSKETSSNTAFLLISGLQPEDEADYYCQVYESSANFVFGGGTQLIIL

SEQ ID NO: 151 - protein, 124 aa, Artificial Sequence
  Description of Artificial Sequence: Synthetic polypeptide
  VH1-46_IGHD6-6*01_IGHJ1*01 S104F
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCAREEYSSFSAEYFQHWGQGTLVTVSSAS

SEQ ID NO: 152 - protein, 124 aa, Artificial Sequence
  Description of Artificial Sequence: Synthetic polypeptide
  VH1-46_IGHD6-6*01_IGHJ1*01 S104A
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCAREEYSSASAEYFQHWGQGTLVTVSSAS

SEQ ID NO: 153 - protein, 124 aa, Artificial Sequence
  Description of Artificial Sequence: Synthetic polypeptide
  VH1-46_IGHD6-6*01_IGHJ1*01 S103P
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCAREEYSPSSAEYFQHWGQGTLVTVSSAS

SEQ ID NO: 154 - protein, 124 aa, Artificial Sequence
  Description of Artificial Sequence: Synthetic polypeptide
  VH1-46_IGHD6-6*01_IGHJ1*01 S102A
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCAREEYASSSAEYFQHWGQGTLVTVSSAS

SEQ ID NO: 155 - protein, 124 aa, Artificial Sequence
  Description of Artificial Sequence: Synthetic polypeptide
  VH1-46_IGHD6-6*01_IGHJ1*01 S102A/S103P/S104F
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCAREEYAPFSAEYFQHWGQGTLVTVSSAS

SEQ ID NO: 156 - protein, 124 aa, Artificial Sequence
  Description of Artificial Sequence: Synthetic polypeptide
  VH1-46_IGHD6-6*01_IGHJ1*01 S102A/S103P/S104F/H111F
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCAREEYAPFSAEYFQFWGQGTLVTVSSAS

SEQ ID NO: 157 - protein, 124 aa, Artificial Sequence
  Description of Artificial Sequence: Synthetic polypeptide
  VH1-46_IGHD6-6*01_IGHJ1*01 S102A/S103P/S104F/H111Y
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCAREEYAPFSAEYFQYWGQGTLVTVSSAS

SEQ ID NO: 158 - protein, 124 aa, Artificial Sequence
  Description of Artificial Sequence: Synthetic polypeptide
  VH1-46_IGHD6-6*01_IGHJ1*01 S102A/S103P/S104Y/H111Y
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCAREEYAPYSAEYFQYWGQGTLVTVSSAS

SEQ ID NO: 159 - protein, 124 aa, Artificial Sequence
  Description of Artificial Sequence: Synthetic polypeptide
  VH1-46_IGHD6-6*01_IGHJ1*01 E100A
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCAREAYSSSSAEYFQHWGQGTLVTVSSAS

SEQ ID NO: 160 - protein, 124 aa, Artificial Sequence
  Description of Artificial Sequence: Synthetic polypeptide
  VH1-46_IGHD6-6*01_IGHJ1*01 Y101A
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCAREEASSSSAEYFQHWGQGTLVTVSSAS

SEQ ID NO: 161 - protein, 124 aa, Artificial Sequence
  Description of Artificial Sequence: Synthetic polypeptide
  VH1-46_IGHD6-6*01_IGHJ1*01 S103A
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCAREEYSASSAEYFQHWGQGTLVTVSSAS

SEQ ID NO: 162 - protein, 124 aa, Artificial Sequence
  Description of Artificial Sequence: Synthetic polypeptide
  VH1-46_IGHD6-6*01_IGHJ1*01 S105A
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCAREEYSSSAAEYFQHWGQGTLVTVSSAS

SEQ ID NO: 163 - protein, 124 aa, Artificial Sequence
  Description of Artificial Sequence: Synthetic polypeptide
  VH1-46_IGHD6-6*01_IGHJ1*01 E107A
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCAREEYSSSSAAYFQHWGQGTLVTVSSAS

SEQ ID NO: 164 - protein, 124 aa, Artificial Sequence
  Description of Artificial Sequence: Synthetic polypeptide
  VH1-46_IGHD6-6*01_IGHJ1*01 Q110A
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCAREEYSSSSAEYFAHWGQGTLVTVSSAS

SEQ ID NO: 165 - protein, 124 aa, Artificial Sequence
  Description of Artificial Sequence: Synthetic polypeptide
  VH1-46_IGHD6-6*01_IGHJ1*01 H111A
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCAREEYSSSSAEYFQAWGQGTLVTVSSAS

SEQ ID NO: 166 - protein, 124 aa, Artificial Sequence
  Description of Artificial Sequence: Synthetic polypeptide
  VH1-46_IGHD6-6*01_IGHJ1*01 S102Q
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCAREEYQSSSAEYFQHWGQGTLVTVSSAS

SEQ ID NO: 167 - protein, 124 aa, Artificial Sequence
  Description of Artificial Sequence: Synthetic polypeptide
  VH1-46_IGHD6-6*01_IGHJ1*01 S102V
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCAREEYVSSSAEYFQHWGQGTLVTVSSAS

SEQ ID NO: 168 - protein, 124 aa, Artificial Sequence
  Description of Artificial Sequence: Synthetic polypeptide
  VH1-46_IGHD6-6*01_IGHJ1*01 S102I
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCAREEYISSSAEYFQHWGQGTLVTVSSAS

SEQ ID NO: 169 - protein, 124 aa, Artificial Sequence
  Description of Artificial Sequence: Synthetic polypeptide
  VH1-46_IGHD6-6*01_IGHJ1*01 S102G
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCAREEYGSSSAEYFQHWGQGTLVTVSSAS

SEQ ID NO: 170 - protein, 124 aa, Artificial Sequence
  Description of Artificial Sequence: Synthetic polypeptide
  VH1-46_IGHD6-6*01_IGHJ1*01 S103L
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCAREEYSLSSAEYFQHWGQGTLVTVSSAS

SEQ ID NO: 171 - protein, 124 aa, Artificial Sequence
  Description of Artificial Sequence: Synthetic polypeptide
  VH1-46_IGHD6-6*01_IGHJ1*01 S103W
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCAREEYSWSSAEYFQHWGQGTLVTVSSAS

SEQ ID NO: 172 - protein, 124 aa, Artificial Sequence
  Description of Artificial Sequence: Synthetic polypeptide
  VH1-46_IGHD6-6*01_IGHJ1*01 S103F
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCAREEYSFSSAEYFQHWGQGTLVTVSSAS

SEQ ID NO: 173 - protein, 124 aa, Artificial Sequence
  Description of Artificial Sequence: Synthetic polypeptide
  VH1-46_IGHD6-6*01_IGHJ1*01 S103N
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCAREEYSNSSAEYFQHWGQGTLVTVSSAS

SEQ ID NO: 174 - protein, 124 aa, Artificial Sequence
  Description of Artificial Sequence: Synthetic polypeptide
  VH1-46_IGHD6-6*01_IGHJ1*01 S103H
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCAREEYSHSSAEYFQHWGQGTLVTVSSAS

SEQ ID NO: 175 - protein, 124 aa, Artificial Sequence
  Description of Artificial Sequence: Synthetic polypeptide
  VH1-46_IGHD6-6*01_IGHJ1*01 S103C
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCAREEYSCSSAEYFQHWGQGTLVTVSSAS

SEQ ID NO: 176 - protein, 124 aa, Artificial Sequence
  Description of Artificial Sequence: Synthetic polypeptide
  VH1-46_IGHD6-6*01_IGHJ1*01 S103G
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCAREEYSGSSAEYFQHWGQGTLVTVSSAS

SEQ ID NO: 177 - protein, 124 aa, Artificial Sequence
  Description of Artificial Sequence: Synthetic polypeptide
  VH1-46_IGHD6-6*01_IGHJ1*01 S104C
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCAREEYSSGSAEYFQHWGQGTLVTVSSAS

SEQ ID NO: 178 - protein, 124 aa, Artificial Sequence
  Description of Artificial Sequence: Synthetic polypeptide
  VH1-46_IGHD6-6*01_IGHJ1*01 S104G
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCAREEYSSCSAEYFQHWGQGTLVTVSSAS

SEQ ID NO: 179 - protein, 124 aa, Artificial Sequence
  Description of Artificial Sequence: Synthetic polypeptide
  VH1-46_IGHD6-6*01_IGHJ1*01 S104H
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCAREEYSSHSAEYFQHWGQGTLVTVSSAS

SEQ ID NO: 180 - protein, 124 aa, Artificial Sequence
  Description of Artificial Sequence: Synthetic polypeptide
  VH1-46_IGHD6-6*01_IGHJ1*01 S104L
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCAREEYSSLSAEYFQHWGQGTLVTVSSAS

SEQ ID NO: 181 - protein, 124 aa, Artificial Sequence
  Description of Artificial Sequence: Synthetic polypeptide
  VH1-46_IGHD6-6*01_IGHJ1*01 S104R
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCAREEYSSRSAEYFQHWGQGTLVTVSSAS

SEQ ID NO: 182 - protein, 124 aa, Artificial Sequence
  Description of Artificial Sequence: Synthetic polypeptide
  VH1-46_IGHD6-6*01_IGHJ1*01 S102A/S103P/S104F G55W
QVQLVQSGAEVKKPGASVKVSCKASGYTFTSYYMHWVRQAPGQGLEWMGIINPSWGSTSYAQKFQGRVTMTRDTSTSTVYMELSSLRSEDTAVYYCAREEYAPFSAEYFQHWGQGTLVTVSSAS

SEQ ID NO: 183 - protein, 124 aa, Artificial Sequence
  Description of Artificial Sequence: Synthetic polypeptide
  VH1-46_IGHD6-6*01_IGHJ1*01 S102A/S103P/S104F G55D
QVQLVQSGAEVKKPGASVKVSCKASGYTFTSYYMHWVRQAPGQGLEWMGIINPSDGSTSYAQKFQGRVTMTRDTSTSTVYMELSSLRSEDTAVYYCAREEYAPFSAEYFQHWGQGTLVTVSSAS

SEQ ID NO: 184 - protein, 124 aa, Artificial Sequence
  Description of Artificial Sequence: Synthetic polypeptide
  VH1-46_IGHD6-6*01_IGHJ1*01 S102A/S103P/S104F A106E
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCAREEYAPFSEEYFQHWGQGTLVTVSSAS

SEQ ID NO: 185 - protein, 124 aa, Artificial Sequence
  Description of Artificial Sequence: Synthetic polypeptide
  VH1-46_IGHD6-6*01_IGHJ1*01 S102A/S103P/S104F H111S
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCAREEYAPFSAEYFQSWGQGTLVTVSSAS

SEQ ID NO: 186 - protein, 124 aa, Artificial Sequence
  Description of Artificial Sequence: Synthetic polypeptide
  VH1-46_IGHD6-6*01_IGHJ1*01 S102A/S103P/S104F/H111F T28A
QVQLVQSGAEVKKPGASVKVSCKASGYAFTSYYMHWVRQAPGQGLEWMGIINPSGGSTSYAQKFQGRVTMTRDTSTSTVYMELSSLRSEDTAVYYCAREEYAPFSAEYFQFWGQGTLVTVSSAS

SEQ ID NO: 187 - protein, 124 aa, Artificial Sequence
  Description of Artificial Sequence: Synthetic polypeptide
  VH1-46_IGHD6-6*01_IGHJ1*01 S102A/S103P/S104F/H111F F29A
QVQLVQSGAEVKKPGASVKVSCKASGYTATSYYMHWVRQAPGQGLEWMGIINPSGGSTSYAQKFQGRVTMTRDTSTSTVYMELSSLRSEDTAVYYCAREEYAPFSAEYFQFWGQGTLVTVSSAS

SEQ ID NO: 188 - protein, 124 aa, Artificial Sequence
  Description of Artificial Sequence: Synthetic polypeptide
  VH1-46_IGHD6-6*01_IGHJ1*01 S102A/S103P/S104F/H111F T30A
QVQLVQSGAEVKKPGASVKVSCKASGYTFASYYMHWVRQAPGQGLEWMGIINPSGGSTSYAQKFQGRVTMTRDTSTSTVYMELSSLRSEDTAVYYCAREEYAPFSAEYFQFWGQGTLVTVSSAS

SEQ ID NO: 189 - protein, 124 aa, Artificial Sequence
  Description of Artificial Sequence: Synthetic polypeptide
  VH1-46_IGHD6-6*01_IGHJ1*01 S102A/S103P/S104F/H111F S31A
QVQLVQSGAEVKKPGASVKVSCKASGYTFTAYYMHWVRQAPGQGLEWMGIINPSGGSTSYAQKFQGRVTMTRDTSTSTVYMELSSLRSEDTAVYYCAREEYAPFSAEYFQFWGQGTLVTVSSAS

SEQ ID NO: 190 - protein, 124 aa, Artificial Sequence
  Description of Artificial Sequence: Synthetic polypeptide
  VH1-46_IGHD6-6*01_IGHJ1*01 S102A/S103P/S104F/H111F Y33A
QVQLVQSGAEVKKPGASVKVSCKASGYTFTSYAMHWVRQAPGQGLEWMGIINPSGGSTSYAQKFQGRVTMTRDTSTSTVYMELSSLRSEDTAVYYCAREEYAPFSAEYFQFWGQGTLVTVSSAS

SEQ ID NO: 191 - protein, 124 aa, Artificial Sequence
  Description of Artificial Sequence: Synthetic polypeptide
  VH1-46_IGHD6-6*01_IGHJ1*01 S102A/S103P/S104F/H111F I50A
QVQLVQSGAEVKKPGASVKVSCKASGYTFTSYYMHWVRQAPGQGLEWMGAINPSGGSTSYAQKFQGRVTMTRDTSTSTVYMELSSLRSEDTAVYYCAREEYAPFSAEYFQFWGQGTLVTVSSAS

SEQ ID NO: 192 - protein, 124 aa, Artificial Sequence
  Description of Artificial Sequence: Synthetic polypeptide
  VH1-46_IGHD6-6*01_IGHJ1*01 S102A/S103P/S104F/H111F I51A
QVQLVQSGAEVKKPGASVKVSCKASGYTFTSYYMHWVRQAPGQGLEWMGIANPSGGSTSYAQKFQGRVTMTRDTSTSTVYMELSSLRSEDTAVYYCAREEYAPFSAEYFQFWGQGTLVTVSSAS

SEQ ID NO: 193 - protein, 124 aa, Artificial Sequence
  Description of Artificial Sequence: Synthetic polypeptide
  VH1-46_IGHD6-6*01_IGHJ1*01 S102A/S103P/S104F/H111F N52A
QVQLVQSGAEVKKPGASVKVSCKASGYTFTSYYMHWVRQAPGQGLEWMGIIAPSGGSTSYAQKFQGRVTMTRDTSTSTVYMELSSLRSEDTAVYYCAREEYAPFSAEYFQFWGQGTLVTVSSAS

SEQ ID NO: 194 - protein, 124 aa, Artificial Sequence
  Description of Artificial Sequence: Synthetic polypeptide
  VH1-46_IGHD6-6*01_IGHJ1*01 S102A/S103P/S104F/H111F P53A
QVQLVQSGAEVKKPGASVKVSCKASGYTFTSYYMHWVRQAPGQGLEWMGIINASGGSTSYAQKFQGRVTMTRDTSTSTVYMELSSLRSEDTAVYYCAREEYAPFSAEYFQFWGQGTLVTVSSAS

SEQ ID NO: 195 - protein, 124 aa, Artificial Sequence
  Description of Artificial Sequence: Synthetic polypeptide
  VH1-46_IGHD6-6*01_IGHJ1*01 S102A/S103P/S104F/H111F S54A
QVQLVQSGAEVKKPGASVKVSCKASGYTFTSYYMHWVRQAPGQGLEWMGIINPAGGSTSYAQKFQGRVTMTRDTSTSTVYMELSSLRSEDTAVYYCAREEYAPFSAEYFQFWGQGTLVTVSSAS

SEQ ID NO: 196 - protein, 124 aa, Artificial Sequence
  Description of Artificial Sequence: Synthetic polypeptide
  VH1-46_IGHD6-6*01_IGHJ1*01 S102A/S103P/S104F/H111F G55A
QVQLVQSGAEVKKPGASVKVSCKASGYTFTSYYMHWVRQAPGQGLEWMGIINPSAGSTSYAQKFQGRVTMTRDTSTSTVYMELSSLRSEDTAVYYCAREEYAPFSAEYFQFWGQGTLVTVSSAS

SEQ ID NO: 197 - protein, 124 aa, Artificial Sequence
  Description of Artificial Sequence: Synthetic polypeptide
  VH1-46_IGHD6-6*01_IGHJ1*01 S102A/S103P/S104F/H111F G56A
QVQLVQSGAEVKKPGASVKVSCKASGYTFTSYYMHWVRQAPGQGLEWMGIINPSGASTSYAQKFQGRVTMTRDTSTSTVYMELSSLRSEDTAVYYCAREEYAPFSAEYFQFWGQGTLVTVSSAS

SEQ ID NO: 198 - protein, 124 aa, Artificial Sequence
  Description of Artificial Sequence: Synthetic polypeptide
  VH1-46_IGHD6-6*01_IGHJ1*01 S102A/S103P/S104F/H111F S57A
QVQLVQSGAEVKKPGASVKVSCKASGYTFTSYYMHWVRQAPGQGLEWMGIINPSGGATSYAQKFQGRVTMTRDTSTSTVYMELSSLRSEDTAVYYCAREEYAPFSAEYFQFWGQGTLVTVSSAS

SEQ ID NO: 199 - protein, 124 aa, Artificial Sequence
  Description of Artificial Sequence: Synthetic polypeptide
  VH1-46_IGHD6-6*01_IGHJ1*01 S102A/S103P/S104F/H111F T58A
QVQLVQSGAEVKKPGASVKVSCKASGYTFTSYYMHWVRQAPGQGLEWMGIINPSGGSASYAQKFQGRVTMTRDTSTSTVYMELSSLRSEDTAVYYCAREEYAPFSAEYFQFWGQGTLVTVSSAS

SEQ ID NO: 200 - protein, 124 aa, Artificial Sequence
  Description of Artificial Sequence: Synthetic polypeptide
  VH1-46_IGHD6-6*01_IGHJ1*01 S102A/S103P/S104F/H111F S59A
QVQLVQSGAEVKKPGASVKVSCKASGYTFTSYYMHWVRQAPGQGLEWMGIINPSGGSTAYAQKFQGRVTMTRDTSTSTVYMELSSLRSEDTAVYYCAREEYAPFSAEYFQFWGQGTLVTVSSAS

SEQ ID NO: 201 - protein, 124 aa, Artificial Sequence
  Description of Artificial Sequence: Synthetic polypeptide
  VH1-46_IGHD6-6*01_IGHJ1*01 S102A/S103P/S104F/H111F I51T/N52V
QVQLVQSGAEVKKPGASVKVSCKASGYTFTSYYMHWVRQAPGQGLEWMGITVPSGGSTSYAQKFQGRVTMTRDTSTSTVYMELSSLRSEDTAVYYCAREEYAPFSAEYFQFWGQGTLVTVSSAS

SEQ ID NO: 202 - protein, 124 aa, Artificial Sequence
  Description of Artificial Sequence: Synthetic polypeptide
  VH1-46_IGHD6-6*01_IGHJ1*01 S102A/S103P/S104F/H111F N52G
QVQLVQSGAEVKKPGASVKVSCKASGYTFTSYYMHWVRQAPGQGLEWMGIIGPSGGSTSYAQKFQGRVTMTRDTSTSTVYMELSSLRSEDTAVYYCAREEYAPFSAEYFQFWGQGTLVTVSSAS

SEQ ID NO: 203 - protein, 124 aa, Artificial Sequence
  Description of Artificial Sequence: Synthetic polypeptide
  VH1-46_IGHD6-6*01_IGHJ1*01 S102A/S103P/S104F/H111F N52T
QVQLVQSGAEVKKPGASVKVSCKASGYTFTSYYMHWVRQAPGQGLEWMGIITPSGGSTSYAQKFQGRVTMTRDTSTSTVYMELSSLRSEDTAVYYCAREEYAPFSAEYFQFWGQGTLVTVSSAS

SEQ ID NO: 204 - protein, 124 aa, Artificial Sequence
  Description of Artificial Sequence: Synthetic polypeptide
  VH1-46_IGHD6-6*01_IGHJ1*01 S102A/S103P/S104F/H111F N52P
QVQLVQSGAEVKKPGASVKVSCKASGYTFTSYYMHWVRQAPGQGLEWMGIIPPSGGSTSYAQKFQGRVTMTRDTSTSTVYMELSSLRSEDTAVYYCAREEYAPFSAEYFQFWGQGTLVTVSSAS

SEQ ID NO: 205 - protein, 124 aa, Artificial Sequence
  Description of Artificial Sequence: Synthetic polypeptide
  VH1-46_IGHD6-6*01_IGHJ1*01 S102A/S103P/S104F/H111F N52L
QVQLVQSGAEVKKPGASVKVSCKASGYTFTSYYMHWVRQAPGQGLEWMGIILPSGGSTSYAQKFQGRVTMTRDTSTSTVYMELSSLRSEDTAVYYCAREEYAPFSAEYFQFWGQGTLVTVSSAS

SEQ ID NO: 206 - protein, 124 aa, Artificial Sequence
  Description of Artificial Sequence: Synthetic polypeptide
  VH1-46_IGHD6-6*01_IGHJ1*01 S102A/S103P/S104F/H111F N52W
QVQLVQSGAEVKKPGASVKVSCKASGYTFTSYYMHWVRQAPGQGLEWMGIIWPSGGSTSYAQKFQGRVTMTRDTSTSTVYMELSSLRSEDTAVYYCAREEYAPFSAEYFQFWGQGTLVTVSSAS

SEQ ID NO: 207 - protein, 124 aa, Artificial Sequence
  Description of Artificial Sequence: Synthetic polypeptide
  VH1-46_IGHD6-6*01_IGHJ1*01 S102A/S103P/S104F/H111F N52Y
QVQLVQSGAEVKKPGASVKVSCKASGYTFTSYYMHWVRQAPGQGLEWMGIIYPSGGSTSYAQKFQGRVTMTRDTSTSTVYMELSSLRSEDTAVYYCAREEYAPFSAEYFQFWGQGTLVTVSSAS

SEQ ID NO: 208 - protein, 124 aa, Artificial Sequence
  Description of Artificial Sequence: Synthetic polypeptide
  VH1-46_IGHD6-6*01_IGHJ1*01 S102A/S103P/S104F/H111F N52V
QVQLVQSGAEVKKPGASVKVSCKASGYTFTSYYMHWVRQAPGQGLEWMGIIVPSGGSTSYAQKFQGRVTMTRDTSTSTVYMELSSLRSEDTAVYYCAREEYAPFSAEYFQFWGQGTLVTVSSAS

SEQ ID NO: 209 - protein, 124 aa, Artificial Sequence
  Description of Artificial Sequence: Synthetic polypeptide
  VH1-46_IGHD6-6*01_IGHJ1*01 S102A/S103P/S104F/H111F N52S
QVQLVQSGAEVKKPGASVKVSCKASGYTFTSYYMHWVRQAPGQGLEWMGIISPSGGSTSYAQKFQGRVTMTRDTSTSTVYMELSSLRSEDTAVYYCAREEYAPFSAEYFQFWGQGTLVTVSSAS

SEQ ID NO: 210 - protein, 124 aa, Artificial Sequence
  Description of Artificial Sequence: Synthetic polypeptide
  VH1-46_IGHD6-6*01_IGHJ1*01 S102A/S103P/S104F/H111F N52Q
QVQLVQSGAEVKKPGASVKVSCKASGYTFTSYYMHWVRQAPGQGLEWMGIIQPSGGSTSYAQKFQGRVTMTRDTSTSTVYMELSSLRSEDTAVYYCAREEYAPFSAEYFQFWGQGTLVTVSSAS

SEQ ID NO: 211 - protein, 124 aa, Artificial Sequence
  Description of Artificial Sequence: Synthetic polypeptide
  VH1-46_IGHD6-6*01_IGHJ1*01 S102A/S103P/S104F/H111F N52K
QVQLVQSGAEVKKPGASVKVSCKASGYTFTSYYMHWVRQAPGQGLEWMGIIKPSGGSTSYAQKFQGRVTMTRDTSTSTVYMELSSLRSEDTAVYYCAREEYAPFSAEYFQFWGQGTLVTVSSAS

SEQ ID NO: 212 - protein, 124 aa, Artificial Sequence
  Description of Artificial Sequence: Synthetic polypeptide
  VH1-46_IGHD6-6*01_IGHJ1*01 S102A/S103P/S104F/H111F G56V
QVQLVQSGAEVKKPGASVKVSCKASGYTFTSYYMHWVRQAPGQGLEWMGIINPSGVSTSYAQKFQGRVTMTRDTSTSTVYMELSSLRSEDTAVYYCAREEYAPFSAEYFQFWGQGTLVTVSSAS

SEQ ID NO: 213 - protein, 124 aa, Artificial Sequence
  Description of Artificial Sequence: Synthetic polypeptide
  VH1-46_IGHD6-6*01_IGHJ1*01 S102A/S103P/S104F/H111F G56E
QVQLVQSGAEVKKPGASVKVSCKASGYTFTSYYMHWVRQAPGQGLEWMGIINPSGESTSYAQKFQGRVTMTRDTSTSTVYMELSSLRSEDTAVYYCAREEYAPFSAEYFQFWGQGTLVTVSSAS

SEQ ID NO: 214 - protein, 124 aa, Artificial Sequence
  Description of Artificial Sequence: Synthetic polypeptide
  VH1-46_IGHD6-6*01_IGHJ1*01 S102A/S103P/S104F/H111F G56S
QVQLVQSGAEVKKPGASVKVSCKASGYTFTSYYMHWVRQAPGQGLEWMGIINPSGSSTSYAQKFQGRVTMTRDTSTSTVYMELSSLRSEDTAVYYCAREEYAPFSAEYFQFWGQGTLVTVSSAS

SEQ ID NO: 215 - protein, 124 aa, Artificial Sequence
  Description of Artificial Sequence: Synthetic polypeptide
  VH1-46_IGHD6-6*01_IGHJ1*01 S102A/S103P/S104F/H111F G56K
QVQLVQSGAEVKKPGASVKVSCKASGYTFTSYYMHWVRQAPGQGLEWMGIINPSGKSTSYAQKFQGRVTMTRDTSTSTVYMELSSLRSEDTAVYYCAREEYAPFSAEYFQFWGQGTLVTVSSAS

SEQ ID NO: 216 - protein, 124 aa, Artificial Sequence
  Description of Artificial Sequence: Synthetic polypeptide
  VH1-46_IGHD6-6*01_IGHJ1*01 S102A/S103P/S104F/H111F G56T
QVQLVQSGAEVKKPGASVKVSCKASGYTFTSYYMHWVRQAPGQGLEWMGIINPSGTSTSYAQKFQGRVTMTRDTSTSTVYMELSSLRSEDTAVYYCAREEYAPFSAEYFQFWGQGTLVTVSSAS

SEQ ID NO: 217 - protein, 124 aa, Artificial Sequence
  Description of Artificial Sequence: Synthetic polypeptide
  VH1-46_IGHD6-6*01_IGHJ1*01 S102A/S103P/S104F/H111F G56L
QVQLVQSGAEVKKPGASVKVSCKASGYTFTSYYMHWVRQAPGQGLEWMGIINPSGLSTSYAQKFQGRVTMTRDTSTSTVYMELSSLRSEDTAVYYCAREEYAPFSAEYFQFWGQGTLVTVSSAS

SEQ ID NO: 218 - protein, 124 aa, Artificial Sequence
  Description of Artificial Sequence: Synthetic polypeptide
  VH1-46_IGHD6-6*01_IGHJ1*01 S102A/S103P/S104F/H111F G56R
QVQLVQSGAEVKKPGASVKVSCKASGYTFTSYYMHWVRQAPGQGLEWMGIINPSGRSTSYAQKFQGRVTMTRDTSTSTVYMELSSLRSEDTAVYYCAREEYAPFSAEYFQFWGQGTLVTVSSAS

SEQ ID NO: 219 - protein, 124 aa, Artificial Sequence
  Description of Artificial Sequence: Synthetic polypeptide
  VH1-46_IGHD6-6*01_IGHJ1*01 S102A/S103P/S104F/H111F G56H
QVQLVQSGAEVKKPGASVKVSCKASGYTFTSYYMHWVRQAPGQGLEWMGIINPSGHSTSYAQKFQGRVTMTRDTSTSTVYMELSSLRSEDTAVYYCAREEYAPFSAEYFQFWGQGTLVTVSSAS

SEQ ID NO: 220 - protein, 124 aa, Artificial Sequence
  Description of Artificial Sequence: Synthetic polypeptide
  VH1-46_IGHD6-6*01_IGHJ1*01 S102A/S103P/S104F/H111F G56I
QVQLVQSGAEVKKPGASVKVSCKASGYTFTSYYMHWVRQAPGQGLEWMGIINPSGISTSYAQKFQGRVTMTRDTSTSTVYMELSSLRSEDTAVYYCAREEYAPFSAEYFQFWGQGTLVTVSSAS

SEQ ID NO: 221 - protein, 124 aa, Artificial Sequence
  Description of Artificial Sequence: Synthetic polypeptide
  VH1-46_IGHD6-6*01_IGHJ1*01 S102A/S103P/S104F/H111F G56W
QVQLVQSGAEVKKPGASVKVSCKASGYTFTSYYMHWVRQAPGQGLEWMGIINPSGWSTSYAQKFQGRVTMTRDTSTSTVYMELSSLRSEDTAVYYCAREEYAPFSAEYFQFWGQGTLVTVSSAS

SEQ ID NO: 222 - protein, 124 aa, Artificial Sequence
  Description of Artificial Sequence: Synthetic polypeptide
  VH1-46_IGHD6-6*01_IGHJ1*01 S102A/S103P/S104F/H111F S54I
QVQLVQSGAEVKKPGASVKVSCKASGYTFTSYYMHWVRQAPGQGLEWMGIINPIGGSTSYAQKFQGRVTMTRDTSTSTVYMELSSLRSEDTAVYYCAREEYAPFSAEYFQFWGQGTLVTVSSAS

SEQ ID NO: 223 - protein, 124 aa, Artificial Sequence
  Description of Artificial Sequence: Synthetic polypeptide
  VH1-46_IGHD6-6*01_IGHJ1*01 S102A/S103P/S104F/H111F S54E
QVQLVQSGAEVKKPGASVKVSCKASGYTFTSYYMHWVRQAPGQGLEWMGIINPEGGSTSYAQKFQGRVTMTRDTSTSTVYMELSSLRSEDTAVYYCAREEYAPFSAEYFQFWGQGTLVTVSSAS

SEQ ID NO: 224 - protein, 124 aa, Artificial Sequence
  Description of Artificial Sequence: Synthetic polypeptide
  VH1-46_IGHD6-6*01_IGHJ1*01 S102A/S103P/S104F/H111F S54R
QVQLVQSGAEVKKPGASVKVSCKASGYTFTSYYMHWVRQAPGQGLEWMGIINPRGGSTSYAQKFQGRVTMTRDTSTSTVYMELSSLRSEDTAVYYCAREEYAPFSAEYFQFWGQGTLVTVSSAS

SEQ ID NO: 225 - protein, 124 aa, Artificial Sequence
  Description of Artificial Sequence: Synthetic polypeptide
  VH1-46_IGHD6-6*01_IGHJ1*01 S102A/S103P/S104F/H111F S54G
QVQLVQSGAEVKKPGASVKVSCKASGYTFTSYYMHWVRQAPGQGLEWMGIINPGGGSTSYAQKFQGRVTMTRDTSTSTVYMELSSLRSEDTAVYYCAREEYAPFSAEYFQFWGQGTLVTVSSAS

SEQ ID NO: 226 - protein, 124 aa, Artificial Sequence
  Description of Artificial Sequence: Synthetic polypeptide
  VH1-46_IGHD6-6*01_IGHJ1*01 S102A/S103P/S104F/H111F S54T
QVQLVQSGAEVKKPGASVKVSCKASGYTFTSYYMHWVRQAPGQGLEWMGIINPTGGSTSYAQKFQGRVTMTRDTSTSTVYMELSSLRSEDTAVYYCAREEYAPFSAEYFQFWGQGTLVTVSSAS

SEQ ID NO: 227 - protein, 124 aa, Artificial Sequence
  Description of Artificial Sequence: Synthetic polypeptide
  VH1-46_IGHD6-6*01_IGHJ1*01 S102A/S103P/S104F/H111F S54L
QVQLVQSGAEVKKPGASVKVSCKASGYTFTSYYMHWVRQAPGQGLEWMGIINPLGGSTSYAQKFQGRVTMTRDTSTSTVYMELSSLRSEDTAVYYCAREEYAPFSAEYFQFWGQGTLVTVSSAS

SEQ ID NO: 228 - protein, 124 aa, Artificial Sequence
  Description of Artificial Sequence: Synthetic polypeptide
  VH1-46_IGHD6-6*01_IGHJ1*01 S102A/S103P/S104F/H111F S54V
QVQLVQSGAEVKKPGASVKVSCKASGYTFTSYYMHWVRQAPGQGLEWMGIINPVGGSTSYAQKFQGRVTMTRDTSTSTVYMELSSLRSEDTAVYYCAREEYAPFSAEYFQFWGQGTLVTVSSAS

SEQ ID NO: 229 - protein, 124 aa, Artificial Sequence
  Description of Artificial Sequence: Synthetic polypeptide
  VH1-46_IGHD6-6*01_IGHJ1*01 S102A/S103P/S104F/H111F S54N
QVQLVQSGAEVKKPGASVKVSCKASGYTFTSYYMHWVRQAPGQGLEWMGIINPNGGSTSYAQKFQGRVTMTRDTSTSTVYMELSSLRSEDTAVYYCAREEYAPFSAEYFQFWGQGTLVTVSSAS

SEQ ID NO: 230 - protein, 124 aa, Artificial Sequence
  Description of Artificial Sequence: Synthetic polypeptide
  VH1-46_IGHD6-6*01_IGHJ1*01 S102A/S103P/S104F/H111F S54P
QVQLVQSGAEVKKPGASVKVSCKASGYTFTSYYMHWVRQAPGQGLEWMGIINPPGGSTSYAQKFQGRVTMTRDTSTSTVYMELSSLRSEDTAVYYCAREEYAPFSAEYFQFWGQGTLVTVSSAS

SEQ ID NO: 231 - protein, 124 aa, Artificial Sequence
  Description of Artificial Sequence: Synthetic polypeptide
  VH1-46_IGHD6-6*01_IGHJ1*01 S102A/S103P/S104F/H111F I50T/S54P
QVQLVQSGAEVKKPGASVKVSCKASGYTFTSYYMHWVRQAPGQGLEWMGTINPPGGSTSYAQKFQGRVTMTRDTSTSTVYMELSSLRSEDTAVYYCAREEYAPFSAEYFQFWGQGTLVTVSSAS

SEQ ID NO: 232 - protein, 124 aa, Artificial Sequence
  Description of Artificial Sequence: Synthetic polypeptide
  VH1-46_IGHD6-6*01_IGHJ1*01 S102A/S103P/S104F/H111F S54A/S59N
QVQLVQSGAEVKKPGASVKVSCKASGYTFTSYYMHWVRQAPGQGLEWMGIINPAGGSTNYAQKFQGRVTMTRDTSTSTVYMELSSLRSEDTAVYYCAREEYAPFSAEYFQFWGQGTLVTVSSAS

SEQ ID NO: 233 - protein, 124 aa, Artificial Sequence
  Description of Artificial Sequence: Synthetic polypeptide
  VH1-46_IGHD6-6*01_IGHJ1*01 S102A/S103P/S104F/H111F N52L/S54T/G56H
QVQLVQSGAEVKKPGASVKVSCKASGYTFTSYYMHWVRQAPGQGLEWMGIILPTGHSTSYAQKFQGRVTMTRDTSTSTVYMELSSLRSEDTAVYYCAREEYAPFSAEYFQFWGQGTLVTVSSAS

SEQ ID NO: 234 - protein, 124 aa, Artificial Sequence
  Description of Artificial Sequence: Synthetic polypeptide
  VH1-46_IGHD6-6*01_IGHJ1*01 S102A/S103P/S104F/H111F I51A/N52L/S54T/G56H
QVQLVQSGAEVKKPGASVKVSCKASGYTFTSYYMHWVRQAPGQGLEWMGIALPTGHSTSYAQKFQGRVTMTRDTSTSTVYMELSSLRSEDTAVYYCAREEYAPFSAEYFQFWGQGTLVTVSSAS

SEQ ID NO: 235 - protein, 124 aa, Artificial Sequence
  Description of Artificial Sequence: Synthetic polypeptide
  VH1-46_IGHD6-6*01_IGHJ1*01 S102A/S103P/S104F/H111F I51T/N52L/S54T/G56H
QVQLVQSGAEVKKPGASVKVSCKASGYTFTSYYMHWVRQAPGQGLEWMGITLPTGHSTSYAQKFQGRVTMTRDTSTSTVYMELSSLRSEDTAVYYCAREEYAPFSAEYFQFWGQGTLVTVSSAS

SEQ ID NO: 236 - protein, 124 aa, Artificial Sequence
  Description of Artificial Sequence: Synthetic polypeptide
  VH1-46_IGHD6-6*01_IGHJ1*01 S102A/S103P/S104F/H111F I51Y/N52L/S54T/G56H
QVQLVQSGAEVKKPGASVKVSCKASGYTFTSYYMHWVRQAPGQGLEWMGIYLPTGHSTSYAQKFQGRVTMTRDTSTSTVYMELSSLRSEDTAVYYCAREEYAPFSAEYFQFWGQGTLVTVSSAS

SEQ ID NO: 237 - protein, 124 aa, Artificial Sequence
  Description of Artificial Sequence: Synthetic polypeptide
  VH1-46_IGHD6-6*01_IGHJ1*01 S102A/S103P/S104F/H111F I51H/N52L/S54T/G56H
QVQLVQSGAEVKKPGASVKVSCKASGYTFTSYYMHWVRQAPGQGLEWMGIHLPTGHSTSYAQKFQGRVTMTRDTSTSTVYMELSSLRSEDTAVYYCAREEYAPFSAEYFQFWGQGTLVTVSSAS

SEQ ID NO: 238 - protein, 124 aa, Artificial Sequence
  Description of Artificial Sequence: Synthetic polypeptide
  VH1-46_IGHD6-6*01_IGHJ1*01 S102A/S103P/S104F/H111F I51E/N52L/S54T/G56H
QVQLVQSGAEVKKPGASVKVSCKASGYTFTSYYMHWVRQAPGQGLEWMGIELPTGHSTSYAQKFQGRVTMTRDTSTSTVYMELSSLRSEDTAVYYCAREEYAPFSAEYFQFWGQGTLVTVSSAS

SEQ ID NO: 239 - protein, 124 aa, Artificial Sequence
  Description of Artificial Sequence: Synthetic polypeptide
  VH1-46_IGHD6-6*01_IGHJ1*01 S102A/S103P/S104F/H111F I51G/N52L/S54T/G56H
QVQLVQSGAEVKKPGASVKVSCKASGYTFTSYYMHWVRQAPGQGLEWMGIGLPTGHSTSYAQKFQGRVTMTRDTSTSTVYMELSSLRSEDTAVYYCAREEYAPFSAEYFQFWGQGTLVTVSSAS

SEQ ID NO: 240 - protein, 124 aa, Artificial Sequence
  Description of Artificial Sequence: Synthetic polypeptide
  VH1-46_IGHD6-6*01_IGHJ1*01 S102A/S103P/S104F/H111F I51V/N52L/S54T/G56H
QVQLVQSGAEVKKPGASVKVSCKASGYTFTSYYMHWVRQAPGQGLEWMGIVLPTGHSTSYAQKFQGRVTMTRDTSTSTVYMELSSLRSEDTAVYYCAREEYAPFSAEYFQFWGQGTLVTVSSAS

SEQ ID NO: 241 - protein, 124 aa, Artificial Sequence
  Description of Artificial Sequence: Synthetic polypeptide
  VH1-46_IGHD6-6*01_IGHJ1*01 S102A/S103P/S104F/H111F I51S/N52L/S54T/G56H
QVQLVQSGAEVKKPGASVKVSCKASGYTFTSYYMHWVRQAPGQGLEWMGISLPTGHSTSYAQKFQGRVTMTRDTSTSTVYMELSSLRSEDTAVYYCAREEYAPFSAEYFQFWGQGTLVTVSSAS

SEQ ID NO: 242 - protein, 124 aa, Artificial Sequence
  Description of Artificial Sequence: Synthetic polypeptide
  VH1-46_IGHD6-6*01_IGHJ1*01 S102A/S103P/S104F/H111F I51W/N52L/S54T/G56H
QVQLVQSGAEVKKPGASVKVSCKASGYTFTSYYMHWVRQAPGQGLEWMGIWLPTGHSTSYAQKFQGRVTMTRDTSTSTVYMELSSLRSEDTAVYYCAREEYAPFSAEYFQFWGQGTLVTVSSAS

SEQ ID NO: 243 - protein, 124 aa, Artificial Sequence
  Description of Artificial Sequence: Synthetic polypeptide
  VH1-46_IGHD6-6*01_IGHJ1*01 S102A/S103P/S104F/H111F I51R/N52L/S54T/G56H
QVQLVQSGAEVKKPGASVKVSCKASGYTFTSYYMHWVRQAPGQGLEWMGIRLPTGHSTSYAQKFQGRVTMTRDTSTSTVYMELSSLRSEDTAVYYCAREEYAPFSAEYFQFWGQGTLVTVSSAS

SEQ ID NO: 244 - protein, 124 aa, Artificial Sequence
  Description of Artificial Sequence: Synthetic polypeptide
  VH1-46_IGHD6-6*01_IGHJ1*01 S102A/S103P/S104F/H111F I51N/N52L/S54T/G56H
QVQLVQSGAEVKKPGASVKVSCKASGYTFTSYYMHWVRQAPGQGLEWMGINLPTGHSTSYAQKFQGRVTMTRDTSTSTVYMELSSLRSEDTAVYYCAREEYAPFSAEYFQFWGQGTLVTVSSAS

SEQ ID NO: 245 - protein, 124 aa, Artificial Sequence
  Description of Artificial Sequence: Synthetic polypeptide
  VH1-46_IGHD6-6*01_IGHJ1*01 S102A/S103P/S104F/H111F I51T/N52L/P53V/S54T/G56H
QVQLVQSGAEVKKPGASVKVSCKASGYTFTSYYMHWVRQAPGQGLEWMGITLVTGHSTSYAQKFQGRVTMTRDTSTSTVYMELSSLRSEDTAVYYCAREEYAPFSAEYFQFWGQGTLVTVSSAS

SEQ ID NO: 246 - protein, 124 aa, Artificial Sequence
  Description of Artificial Sequence: Synthetic polypeptide
  VH1-46_IGHD6-6*01_IGHJ1*01 S102A/S103P/S104F/H111F I51T/N52L/P53G/S54T/G56H
QVQLVQSGAEVKKPGASVKVSCKASGYTFTSYYMHWVRQAPGQGLEWMGITLGTGHSTSYAQKFQGRVTMTRDTSTSTVYMELSSLRSEDTAVYYCAREEYAPFSAEYFQFWGQGTLVTVSSAS

SEQ ID NO: 247 - protein, 124 aa, Artificial Sequence
  Description of Artificial Sequence: Synthetic polypeptide
  VH1-46_IGHD6-6*01_IGHJ1*01 S102A/S103P/S104F/H111F I51T/N52L/P53S/S54T/G56H
QVQLVQSGAEVKKPGASVKVSCKASGYTFTSYYMHWVRQAPGQGLEWMGITLSTGHSTSYAQKFQGRVTMTRDTSTSTVYMELSSLRSEDTAVYYCAREEYAPFSAEYFQFWGQGTLVTVSSAS

SEQ ID NO: 248 - protein, 124 aa, Artificial Sequence
  Description of Artificial Sequence: Synthetic polypeptide
  VH1-46_IGHD6-6*01_IGHJ1*01 S102A/S103P/S104F/H111F I51T/N52L/P53W/S54T/G56H
QVQLVQSGAEVKKPGASVKVSCKASGYTFTSYYMHWVRQAPGQGLEWMGITLWTGHSTSYAQKFQGRVTMTRDTSTSTVYMELSSLRSEDTAVYYCAREEYAPFSAEYFQFWGQGTLVTVSSAS

SEQ ID NO: 249 - protein, 124 aa, Artificial Sequence
  Description of Artificial Sequence: Synthetic polypeptide
  VH1-46_IGHD6-6*01_IGHJ1*01 S102A/S103P/S104F/H111F I51T/N52L/P53R/S54T/G56H
QVQLVQSGAEVKKPGASVKVSCKASGYTFTSYYMHWVRQAPGQGLEWMGITLRTGHSTSYAQKFQGRVTMTRDTSTSTVYMELSSLRSEDTAVYYCAREEYAPFSAEYFQFWGQGTLVTVSSAS

SEQ ID NO: 250 - protein, 124 aa, Artificial Sequence
  Description of Artificial Sequence: Synthetic polypeptide
  VH1-46_IGHD6-6*01_IGHJ1*01 S102A/S103P/S104F/H111F I51T/N52L/P53N/S54T/G56H
QVQLVQSGAEVKKPGASVKVSCKASGYTFTSYYMHWVRQAPGQGLEWMGITLNTGHSTSYAQKFQGRVTMTRDTSTSTVYMELSSLRSEDTAVYYCAREEYAPFSAEYFQFWGQGTLVTVSSAS

SEQ ID NO: 251 - protein, 124 aa, Artificial Sequence
  Description of Artificial Sequence: Synthetic polypeptide
  VH1-46_IGHD6-6*01_IGHJ1*01 S102A/S103P/S104F/H111F I51T/N52L/P53A/S54T/G56H
QVQLVQSGAEVKKPGASVKVSCKASGYTFTSYYMHWVRQAPGQGLEWMGITLATGHSTSYAQKFQGRVTMTRDTSTSTVYMELSSLRSEDTAVYYCAREEYAPFSAEYFQFWGQGTLVTVSSAS

SEQ ID NO: 252 - protein, 124 aa, Artificial Sequence
  Description of Artificial Sequence: Synthetic polypeptide
  VH1-46_IGHD6-6*01_IGHJ1*01 S102A/S103P/S104F/H111F I51T/N52L/P53T/S54T/G56H
QVQLVQSGAEVKKPGASVKVSCKASGYTFTSYYMHWVRQAPGQGLEWMGITLTTGHSTSYAQKFQGRVTMTRDTSTSTVYMELSSLRSEDTAVYYCAREEYAPFSAEYFQFWGQGTLVTVSSAS

SEQ ID NO: 253 - protein, 124 aa, Artificial Sequence; identical to SEQ ID NO: 235
  Description of Artificial Sequence: Synthetic polypeptide
  VH1-46_IGHD6-6*01_IGHJ1*01 S102A/S103P/S104F/H111F I51T/N52L/P53Y/S54T/G56H

SEQ ID NO: 254 - protein, 124 aa, Artificial Sequence
  Description of Artificial Sequence: Synthetic polypeptide
  VH1-46_IGHD6-6*01_IGHJ1*01 S102A/S103P/S104F/H111F I51T/N52L/P53H/S54T/G56H
QVQLVQSGAEVKKPGASVKVSCKASGYTFTSYYMHWVRQAPGQGLEWMGITLHTGHSTSYAQKFQGRVTMTRDTSTSTVYMELSSLRSEDTAVYYCAREEYAPFSAEYFQFWGQGTLVTVSSAS

SEQ ID NO: 255 - protein, 124 aa, Artificial Sequence
  Description of Artificial Sequence: Synthetic polypeptide
  VH1-46_IGHD6-6*01_IGHJ1*01 S102A/S103P/S104F/H111F I51T/N52L/P53E/S54T/G56H
QVQLVQSGAEVKKPGASVKVSCKASGYTFTSYYMHWVRQAPGQGLEWMGITLETGHSTSYAQKFQGRVTMTRDTSTSTVYMELSSLRSEDTAVYYCAREEYAPFSAEYFQFWGQGTLVTVSSAS

SEQ ID NO: 256 - protein, 124 aa, Artificial Sequence
  Description of Artificial Sequence: Synthetic polypeptide
  VH1-46_IGHD6-6*01_IGHJ1*01 S102A/S103P/S104F/H111F I51T/N52L/P53M/S54T/G56H
QVQLVQSGAEVKKPGASVKVSCKASGYTFTSYYMHWVRQAPGQGLEWMGITLMTGHSTSYAQKFQGRVTMTRDTSTSTVYMELSSLRSEDTAVYYCAREEYAPFSAEYFQFWGQGTLVTVSSAS

SEQ ID NO: 257 - protein, 124 aa, Artificial Sequence
  Description of Artificial Sequence: Synthetic polypeptide
  VH1-46_IGHD6-6*01_IGHJ1*01 S102A/S103P/S104F/H111F S84G
QVQLVQSGAEVKKPGASVKVSCKASGYTFTSYYMHWVRQAPGQGLEWMGIINPSGGSTSYAQKFQGRVTMTRDTSTSTVYMELGSLRSEDTAVYYCAREEYAPFSAEYFQFWGQGTLVTVSSAS

SEQ ID NO: 258 - protein, 124 aa, Artificial Sequence
  Description of Artificial Sequence: Synthetic polypeptide
  VH1-46_IGHD6-6*01_IGHJ1*01 S102A/S103P/S104F/H111F S84Q
QVQLVQSGAEVKKPGASVKVSCKASGYTFTSYYMHWVRQAPGQGLEWMGIINPSGGSTSYAQKFQGRVTMTRDTSTSTVYMELQSLRSEDTAVYYCAREEYAPFSAEYFQFWGQGTLVTVSSAS

SEQ ID NO: 259 - protein, 124 aa, Artificial Sequence
  Description of Artificial Sequence: Synthetic polypeptide
  VH1-46_IGHD6-6*01_IGHJ1*01 S102A/S103P/S104F/H111F S84N
QVQLVQSGAEVKKPGASVKVSCKASGYTFTSYYMHWVRQAPGQGLEWMGIINPSGGSTSYAQKFQGRVTMTRDTSTSTVYMELNSLRSEDTAVYYCAREEYAPFSAEYFQFWGQGTLVTVSSAS

SEQ ID NO: 260 - protein, 124 aa, Artificial Sequence
  Description of Artificial Sequence: Synthetic polypeptide
  VH1-46_IGHD6-6*01_IGHJ1*01 S102A/S103P/S104F/H111F S84H
QVQLVQSGAEVKKPGASVKVSCKASGYTFTSYYMHWVRQAPGQGLEWMGIINPSGGSTSYAQKFQGRVTMTRDTSTSTVYMELHSLRSEDTAVYYCAREEYAPFSAEYFQFWGQGTLVTVSSAS

SEQ ID NO: 261 - protein, 124 aa, Artificial Sequence
  Description of Artificial Sequence: Synthetic polypeptide
  VH1-46_IGHD6-6*01_IGHJ1*01 S102A/S103P/S104F/H111F S84R
QVQLVQSGAEVKKPGASVKVSCKASGYTFTSYYMHWVRQAPGQGLEWMGIINPSGGSTSYAQKFQGRVTMTRDTSTSTVYMELRSLRSEDTAVYYCAREEYAPFSAEYFQFWGQGTLVTVSSAS

SEQ ID NO: 262 - protein, 124 aa, Artificial Sequence
  Description of Artificial Sequence: Synthetic polypeptide
  VH1-46_IGHD6-6*01_IGHJ1*01 S102A/S103P/S104F/H111F S84K
QVQLVQSGAEVKKPGASVKVSCKASGYTFTSYYMHWVRQAPGQGLEWMGIINPSGGSTSYAQKFQGRVTMTRDTSTSTVYMELKSLRSEDTAVYYCAREEYAPFSAEYFQFWGQGTLVTVSSAS

SEQ ID NO: 263 - protein, 124 aa, Artificial Sequence
  Description of Artificial Sequence: Synthetic polypeptide
  VH1-46_IGHD6-6*01_IGHJ1*01 S102A/S103P/S104F/H111F S84T
QVQLVQSGAEVKKPGASVKVSCKASGYTFTSYYMHWVRQAPGQGLEWMGIINPSGGSTSYAQKFQGRVTMTRDTSTSTVYMELTSLRSEDTAVYYCAREEYAPFSAEYFQFWGQGTLVTVSSAS

SEQ ID NO: 264 - protein, 110 aa, Artificial Sequence
  Description of Artificial Sequence: Synthetic polypeptide
  L6_IGKJ1*01 S28P
EIVLTQSPATLSLSPGERATLSCRASQPVSSYLAWYQQKPGQAPRLLIYDASNRATGIPARFSGSGSGTDFTLTISSLEPEDFAVYYCQQRSNWPPWTFGQGTKVEIKRT

SEQ ID NO: 265 - protein, 110 aa, Artificial Sequence
  Description of Artificial Sequence: Synthetic polypeptide
  L6_IGKJ1*01 S30N
EIVLTQSPATLSLSPGERATLSCRASQSVNSYLAWYQQKPGQAPRLLIYDASNRATGIPARFSGSGSGTDFTLTISSLEPEDFAVYYCQQRSNWPPWTFGQGTKVEIKRT

SEQ ID NO: 266 - protein, 110 aa, Artificial Sequence
  Description of Artificial Sequence: Synthetic polypeptide
  L6_IGKJ1*01 S31K
EIVLTQSPATLSLSPGERATLSCRASQSVSKYLAWYQQKPGQAPRLLIYDASNRATGIPARFSGSGSGTDFTLTISSLEPEDFAVYYCQQRSNWPPWTFGQGTKVEIKRT

SEQ ID NO: 267 - protein, 110 aa, Artificial Sequence
  Description of Artificial Sequence: Synthetic polypeptide
  L6_IGKJ1*01 R91P
EIVLTQSPATLSLSPGERATLSCRASQSVSSYLAWYQQKPGQAPRLLIYDASNRATGIPARFSGSGSGTDFTLTISSLEPEDFAVYYCQQPSNWPPWTFGQGTKVEIKRT

SEQ ID NO: 268 - protein, 110 aa, Artificial Sequence
  Description of Artificial Sequence: Synthetic polypeptide
  L6_IGKJ1*01 R91L
EIVLTQSPATLSLSPGERATLSCRASQSVSSYLAWYQQKPGQAPRLLIYDASNRATGIPARFSGSGSGTDFTLTISSLEPEDFAVYYCQQLSNWPPWTFGQGTKVEIKRT

SEQ ID NO: 269 - protein, 110 aa, Artificial Sequence
  Description of Artificial Sequence: Synthetic polypeptide
  L6_IGKJ1*01 R91G
EIVLTQSPATLSLSPGERATLSCRASQSVSSYLAWYQQKPGQAPRLLIYDASNRATGIPARFSGSGSGTDFTLTISSLEPEDFAVYYCQQGSNWPPWTFGQGTKVEIKRT

SEQ ID NO: 270 - protein, 110 aa, Artificial Sequence
  Description of Artificial Sequence: Synthetic polypeptide
  L6_IGKJ1*01 R91Q
EIVLTQSPATLSLSPGERATLSCRASQSVSSYLAWYQQKPGQAPRLLIYDASNRATGIPARFSGSGSGTDFTLTISSLEPEDFAVYYCQQQSNWPPWTFGQGTKVEIKRT

SEQ ID NO: 271 - protein, 110 aa, Artificial Sequence
  Description of Artificial Sequence: Synthetic polypeptide
  L6_IGKJ1*01 S92N
EIVLTQSPATLSLSPGERATLSCRASQSVSSYLAWYQQKPGQAPRLLIYDASNRATGIPARFSGSGSGTDFTLTISSLEPEDFAVYYCQQRNNWPPWTFGQGTKVEIKRT

SEQ ID NO: 272 - protein, 110 aa, Artificial Sequence
  Description of Artificial Sequence: Synthetic polypeptide
  L6_IGKJ1*01 S92C
EIVLTQSPATLSLSPGERATLSCRASQSVSSYLAWYQQKPGQAPRLLIYDASNRATGIPARFSGSGSGTDFTLTISSLEPEDFAVYYCQQRCNWPPWTFGQGTKVEIKRT

SEQ ID NO: 273 - protein, 110 aa, Artificial Sequence
  Description of Artificial Sequence: Synthetic polypeptide
  L6_IGKJ1*01 N93Y
EIVLTQSPATLSLSPGERATLSCRASQSVSSYLAWYQQKPGQAPRLLIYDASNRATGIPARFSGSGSGTDFTLTISSLEPEDFAVYYCQQRSYWPPWTFGQGTKVEIKRT

SEQ ID NO: 274 - protein, 110 aa, Artificial Sequence
  Description of Artificial Sequence: Synthetic polypeptide
  L6_IGKJ1*01 N93S
EIVLTQSPATLSLSPGERATLSCRASQSVSSYLAWYQQKPGQAPRLLIYDASNRATGIPARFSGSGSGTDFTLTISSLEPEDFAVYYCQQRSSWPPWTFGQGTKVEIKRT

SEQ ID NO: 275 - protein, 110 aa, Artificial Sequence
  Description of Artificial Sequence: Synthetic polypeptide
  L6_IGKJ1*01 N93H
EIVLTQSPATLSLSPGERATLSCRASQSVSSYLAWYQQKPGQAPRLLIYDASNRATGIPARFSGSGSGTDFTLTISSLEPEDFAVYYCQQRSHWPPWTFGQGTKVEIKRT

SEQ ID NO: 276 - protein, 110 aa, Artificial Sequence
  Description of Artificial Sequence: Synthetic polypeptide
  L6_IGKJ1*01 N93Q
EIVLTQSPATLSLSPGERATLSCRASQSVSSYLAWYQQKPGQAPRLLIYDASNRATGIPARFSGSGSGTDFTLTISSLEPEDFAVYYCQQRSQWPPWTFGQGTKVEIKRT

SEQ ID NO: 277 - protein, 110 aa, Artificial Sequence
  Description of Artificial Sequence: Synthetic polypeptide
  L6_IGKJ1*01 W94R
EIVLTQSPATLSLSPGERATLSCRASQSVSSYLAWYQQKPGQAPRLLIYDASNRATGIPARFSGSGSGTDFTLTISSLEPEDFAVYYCQQRSNRPPWTFGQGTKVEIKRT

SEQ ID NO: 278 - protein, 110 aa, Artificial Sequence
  Description of Artificial Sequence: Synthetic polypeptide
  L6_IGKJ1*01 W94S
EIVLTQSPATLSLSPGERATLSCRASQSVSSYLAWYQQKPGQAPRLLIYDASNRATGIPARFSGSGSGTDFTLTISSLEPEDFAVYYCQQRSNSPPWTFGQGTKVEIKRT

SEQ ID NO: 279 - protein, 110 aa, Artificial Sequence
  Description of Artificial Sequence: Synthetic polypeptide
  L6_IGKJ1*01 W94T
EIVLTQSPATLSLSPGERATLSCRASQSVSSYLAWYQQKPGQAPRLLIYDASNRATGIPARFSGSGSGTDFTLTISSLEPEDFAVYYCQQRSNTPPWTFGQGTKVEIKRT

SEQ ID NO: 280 - protein, 110 aa, Artificial Sequence
  Description of Artificial Sequence: Synthetic polypeptide
  L6_IGKJ1*01 W94L
EIVLTQSPATLSLSPGERATLSCRASQSVSSYLAWYQQKPGQAPRLLIYDASNRATGIPARFSGSGSGTDFTLTISSLEPEDFAVYYCQQRSNLPPWTFGQGTKVEIKRT

SEQ ID NO: 281 - protein, 110 aa, Artificial Sequence
  Description of Artificial Sequence: Synthetic polypeptide
  L6_IGKJ1*01 W94P
EIVLTQSPATLSLSPGERATLSCRASQSVSSYLAWYQQKPGQAPRLLIYDASNRATGIPARFSGSGSGTDFTLTISSLEPEDFAVYYCQQRSNPPPWTFGQGTKVEIKRT

SEQ ID NO: 282 - protein, 110 aa, Artificial Sequence
  Description of Artificial Sequence: Synthetic polypeptide
  L6_IGKJ1*01 W94M
EIVLTQSPATLSLSPGERATLSCRASQSVSSYLAWYQQKPGQAPRLLIYDASNRATGIPARFSGSGSGTDFTLTISSLEPEDFAVYYCQQRSNMPPWTFGQGTKVEIKRT

SEQ ID NO: 283 - protein, 110 aa, Artificial Sequence
  Description of Artificial Sequence: Synthetic polypeptide
  L6_IGKJ1*01 S92P
EIVLTQSPATLSLSPGERATLSCRASQSVSSYLAWYQQKPGQAPRLLIYDASNRATGIPARFSGSGSGTDFTLTISSLEPEDFAVYYCQQRPNWPPWTFGQGTKVEIKRT

SEQ ID NO: 284 - protein, 110 aa, Artificial Sequence
  Description of Artificial Sequence: Synthetic polypeptide
  L6_IGKJ1*01 S92A
EIVLTQSPATLSLSPGERATLSCRASQSVSSYLAWYQQKPGQAPRLLIYDASNRATGIPARFSGSGSGTDFTLTISSLEPEDFAVYYCQQRANWPPWTFGQGTKVEIKRT

SEQ ID NO: 285 - protein, 110 aa, Artificial Sequence
  Description of Artificial Sequence: Synthetic polypeptide
  L6_IGKJ1*01 S92Q
EIVLTQSPATLSLSPGERATLSCRASQSVSSYLAWYQQKPGQAPRLLIYDASNRATGIPARFSGSGSGTDFTLTISSLEPEDFAVYYCQQRQNWPPWTFGQGTKVEIKRT

SEQ ID NO: 286 - protein, 110 aa, Artificial Sequence
  Description of Artificial Sequence: Synthetic polypeptide
  L6_IGKJ1*01 S92V
EIVLTQSPATLSLSPGERATLSCRASQSVSSYLAWYQQKPGQAPRLLIYDASNRATGIPARFSGSGSGTDFTLTISSLEPEDFAVYYCQQRVNWPPWTFGQGTKVEIKRT

SEQ ID NO: 287 - protein, 110 aa, Artificial Sequence
  Description of Artificial Sequence: Synthetic polypeptide
  L6_IGKJ1*01 S92T
EIVLTQSPATLSLSPGERATLSCRASQSVSSYLAWYQQKPGQAPRLLIYDASNRATGIPARFSGSGSGTDFTLTISSLEPEDFAVYYCQQRTNWPPWTFGQGTKVEIKRT

SEQ ID NO: 288 - protein, 110 aa, Artificial Sequence
  Description of Artificial Sequence: Synthetic polypeptide
  L6_IGKJ1*01 S92R
EIVLTQSPATLSLSPGERATLSCRASQSVSSYLAWYQQKPGQAPRLLIYDASNRATGIPARFSGSGSGTDFTLTISSLEPEDFAVYYCQQRRNWPPWTFGQGTKVEIKRT

SEQ ID NO: 289 - protein, 110 aa, Artificial Sequence
  Description of Artificial Sequence: Synthetic polypeptide
  L6_IGKJ1*01 S92G
EIVLTQSPATLSLSPGERATLSCRASQSVSSYLAWYQQKPGQAPRLLIYDASNRATGIPARFSGSGSGTDFTLTISSLEPEDFAVYYCQQRGNWPPWTFGQGTKVEIKRT

SEQ ID NO: 290 - protein, 110 aa, Artificial Sequence; identical to SEQ ID NO: 286
  Description of Artificial Sequence: Synthetic polypeptide
  L6_IGKJ1*01 S92V

SEQ ID NO: 291 - protein, 110 aa, Artificial Sequence
  Description of Artificial Sequence: Synthetic polypeptide
  L6_IGKJ1*01 S92M
EIVLTQSPATLSLSPGERATLSCRASQSVSSYLAWYQQKPGQAPRLLIYDASNRATGIPARFSGSGSGTDFTLTISSLEPEDFAVYYCQQRMNWPPWTFGQGTKVEIKRT

SEQ ID NO: 292 - protein, 110 aa, Artificial Sequence
  Description of Artificial Sequence: Synthetic polypeptide
  L6_IGKJ1*01 S30W
EIVLTQSPATLSLSPGERATLSCRASQSVWSYLAWYQQKPGQAPRLLIYDASNRATGIPARFSGSGSGTDFTLTISSLEPEDFAVYYCQQRSNWPPWTFGQGTKVEIKRT

SEQ ID NO: 293 - protein, 110 aa, Artificial Sequence
  Description of Artificial Sequence: Synthetic polypeptide
  L6_IGKJ1*01 S30R
EIVLTQSPATLSLSPGERATLSCRASQSVRSYLAWYQQKPGQAPRLLIYDASNRATGIPARFSGSGSGTDFTLTISSLEPEDFAVYYCQQRSNWPPWTFGQGTKVEIKRT

SEQ ID NO: 294 - protein, 110 aa, Artificial Sequence
  Description of Artificial Sequence: Synthetic polypeptide
  L6_IGKJ1*01 S30T
EIVLTQSPATLSLSPGERATLSCRASQSVTSYLAWYQQKPGQAPRLLIYDASNRATGIPARFSGSGSGTDFTLTISSLEPEDFAVYYCQQRSNWPPWTFGQGTKVEIKRT

SEQ ID NO: 295 - protein, 110 aa, Artificial Sequence
  Description of Artificial Sequence: Synthetic polypeptide
  L6_IGKJ1*01 S30L
EIVLTQSPATLSLSPGERATLSCRASQSVLSYLAWYQQKPGQAPRLLIYDASNRATGIPARFSGSGSGTDFTLTISSLEPEDFAVYYCQQRSNWPPWTFGQGTKVEIKRT

SEQ ID NO: 296 - protein, 110 aa, Artificial Sequence
  Description of Artificial Sequence: Synthetic polypeptide
  L6_IGKJ1*01 R24G/Q27L
EIVLTQSPATLSLSPGERATLSCGASLSVSSYLAWYQQKPGQAPRLLIYDASNRATGIPARFSGSGSGTDFTLTISSLEPEDFAVYYCQQRSNWPPWTFGQGTKVEIKRT

SEQ ID NO: 297 - protein, 110 aa, Artificial Sequence
  Description of Artificial Sequence: Synthetic polypeptide
  L6_IGKJ1*01 Y32V
EIVLTQSPATLSLSPGERATLSCRASQSVSSVLAWYQQKPGQAPRLLIYDASNRATGIPARFSGSGSGTDFTLTISSLEPEDFAVYYCQQRSNWPPWTFGQGTKVEIKRT

SEQ ID NO: 298 - protein, 110 aa, Artificial Sequence
  Description of Artificial Sequence: Synthetic polypeptide
  L6_IGKJ1*01 Y32S
EIVLTQSPATLSLSPGERATLSCRASQSVSSSLAWYQQKPGQAPRLLIYDASNRATGIPARFSGSGSGTDFTLTISSLEPEDFAVYYCQQRSNWPPWTFGQGTKVEIKRT

SEQ ID NO: 299 - protein, 110 aa, Artificial Sequence
  Description of Artificial Sequence: Synthetic polypeptide
  L6_IGKJ1*01 S28G
EIVLTQSPATLSLSPGERATLSCRASQGVSSYLAWYQQKPGQAPRLLIYDASNRATGIPARFSGSGSGTDFTLTISSLEPEDFAVYYCQQRSNWPPWTFGQGTKVEIKRT

SEQ ID NO: 300 - protein, 110 aa, Artificial Sequence
  Description of Artificial Sequence: Synthetic polypeptide
  L6_IGKJ1*01 S28K
EIVLTQSPATLSLSPGERATLSCRASQKVSSYLAWYQQKPGQAPRLLIYDASNRATGIPARFSGSGSGTDFTLTISSLEPEDFAVYYCQQRSNWPPWTFGQGTKVEIKRT

SEQ ID NO: 301 - protein, 110 aa, Artificial Sequence
  Description of Artificial Sequence: Synthetic polypeptide
  L6_IGKJ1*01 S28V
EIVLTQSPATLSLSPGERATLSCRASQVVSSYLAWYQQKPGQAPRLLIYDASNRATGIPARFSGSGSGTDFTLTISSLEPEDFAVYYCQQRSNWPPWTFGQGTKVEIKRT

SEQ ID NO: 302 - protein, 110 aa, Artificial Sequence
  Description of Artificial Sequence: Synthetic polypeptide
  L6_IGKJ1*01 S28F
EIVLTQSPATLSLSPGERATLSCRASQFVSSYLAWYQQKPGQAPRLLIYDASNRATGIPARFSGSGSGTDFTLTISSLEPEDFAVYYCQQRSNWPPWTFGQGTKVEIKRT

SEQ ID NO: 303 - protein, 110 aa, Artificial Sequence
  Description of Artificial Sequence: Synthetic polypeptide
  L6_IGKJ1*01 S28T
EIVLTQSPATLSLSPGERATLSCRASQTVSSYLAWYQQKPGQAPRLLIYDASNRATGIPARFSGSGSGTDFTLTISSLEPEDFAVYYCQQRSNWPPWTFGQGTKVEIKRT

SEQ ID NO: 304 - protein, 110 aa, Artificial Sequence
  Description of Artificial Sequence: Synthetic polypeptide
  L6_IGKJ1*01 S28L
EIVLTQSPATLSLSPGERATLSCRASQLVSSYLAWYQQKPGQAPRLLIYDASNRATGIPARFSGSGSGTDFTLTISSLEPEDFAVYYCQQRSNWPPWTFGQGTKVEIKRT

SEQ ID NO: 305 - protein, 110 aa, Artificial Sequence
  Description of Artificial Sequence: Synthetic polypeptide
  L6_IGKJ1*01 S28Q
EIVLTQSPATLSLSPGERATLSCRASQQVSSYLAWYQQKPGQAPRLLIYDASNRATGIPARFSGSGSGTDFTLTISSLEPEDFAVYYCQQRSNWPPWTFGQGTKVEIKRT

SEQ ID NO: 306 - protein, 110 aa, Artificial Sequence
  Description of Artificial Sequence: Synthetic polypeptide
  L6_IGKJ1*01 S28A
EIVLTQSPATLSLSPGERATLSCRASQAVSSYLAWYQQKPGQAPRLLIYDASNRATGIPARFSGSGSGTDFTLTISSLEPEDFAVYYCQQRSNWPPWTFGQGTKVEIKRT

SEQ ID NO: 307 - protein, 110 aa, Artificial Sequence
  Description of Artificial Sequence: Synthetic polypeptide
  L6_IGKJ1*01 S28N
EIVLTQSPATLSLSPGERATLSCRASQNVSSYLAWYQQKPGQAPRLLIYDASNRATGIPARFSGSGSGTDFTLTISSLEPEDFAVYYCQQRSNWPPWTFGQGTKVEIKRT

SEQ ID NO: 308 - protein, 110 aa, Artificial Sequence
  Description of Artificial Sequence: Synthetic polypeptide
  L6_IGKJ1*01 S28H
EIVLTQSPATLSLSPGERATLSCRASQHVSSYLAWYQQKPGQAPRLLIYDASNRATGIPARFSGSGSGTDFTLTISSLEPEDFAVYYCQQRSNWPPWTFGQGTKVEIKRT

SEQ ID NO: 309 - protein, 110 aa, Artificial Sequence
  Description of Artificial Sequence: Synthetic polypeptide
  L6_IGKJ1*01 S28I
EIVLTQSPATLSLSPGERATLSCRASQIVSSYLAWYQQKPGQAPRLLIYDASNRATGIPARFSGSGSGTDFTLTISSLEPEDFAVYYCQQRSNWPPWTFGQGTKVEIKRT

SEQ ID NO: 310 - protein, 110 aa, Artificial Sequence
  Description of Artificial Sequence: Synthetic polypeptide
  L6_IGKJ1*01 S28R
EIVLTQSPATLSLSPGERATLSCRASQRVSSYLAWYQQKPGQAPRLLIYDASNRATGIPARFSGSGSGTDFTLTISSLEPEDFAVYYCQQRSNWPPWTFGQGTKVEIKRT

SEQ ID NO: 311 - protein, 110 aa, Artificial Sequence
  Description of Artificial Sequence: Synthetic polypeptide
  L6_IGKJ1*01 S28W
EIVLTQSPATLSLSPGERATLSCRASQWVSSYLAWYQQKPGQAPRLLIYDASNRATGIPARFSGSGSGTDFTLTISSLEPEDFAVYYCQQRSNWPPWTFGQGTKVEIKRT

SEQ ID NO: 312 - protein, 110 aa, Artificial Sequence
  Description of Artificial Sequence: Synthetic polypeptide
  L6_IGKJ1*01 S28M
EIVLTQSPATLSLSPGERATLSCRASQMVSSYLAWYQQKPGQAPRLLIYDASNRATGIPARFSGSGSGTDFTLTISSLEPEDFAVYYCQQRSNWPPWTFGQGTKVEIKRT

SEQ ID NO: 313 - protein, 110 aa, Artificial Sequence
  Description of Artificial Sequence: Synthetic polypeptide
  L6_IGKJ1*01 S28E
EIVLTQSPATLSLSPGERATLSCRASQEVSSYLAWYQQKPGQAPRLLIYDASNRATGIPARFSGSGSGTDFTLTISSLEPEDFAVYYCQQRSNWPPWTFGQGTKVEIKRT

SEQ ID NO: 314 - protein, 110 aa, Artificial Sequence
  Description of Artificial Sequence: Synthetic polypeptide
  L6_IGKJ1*01 S30C
EIVLTQSPATLSLSPGERATLSCRASQSVCSYLAWYQQKPGQAPRLLIYDASNRATGIPARFSGSGSGTDFTLTISSLEPEDFAVYYCQQRSNWPPWTFGQGTKVEIKRT

SEQ ID NO: 315 - protein, 110 aa, Artificial Sequence
  Description of Artificial Sequence: Synthetic polypeptide
  L6_IGKJ1*01 S30D
EIVLTQSPATLSLSPGERATLSCRASQSVDSYLAWYQQKPGQAPRLLIYDASNRATGIPARFSGSGSGTDFTLTISSLEPEDFAVYYCQQRSNWPPWTFGQGTKVEIKRT

SEQ ID NO: 316 - protein, 110 aa, Artificial Sequence; identical to SEQ ID NO: 295
  Description of Artificial Sequence: Synthetic polypeptide
  L6_IGKJ1*01 S30L

SEQ ID NO: 317 - protein, 110 aa, Artificial Sequence; identical to SEQ ID NO: 294
  Description of Artificial Sequence: Synthetic polypeptide
  L6_IGKJ1*01 S30T

SEQ ID NO: 318 - protein, 110 aa, Artificial Sequence; identical to SEQ ID NO: 293
  Description of Artificial Sequence: Synthetic polypeptide
  L6_IGKJ1*01 S30R

SEQ ID NO: 319 - protein, 110 aa, Artificial Sequence
  Description of Artificial Sequence: Synthetic polypeptide
  L6_IGKJ1*01 S30P
EIVLTQSPATLSLSPGERATLSCRASQSVPSYLAWYQQKPGQAPRLLIYDASNRATGIPARFSGSGSGTDFTLTISSLEPEDFAVYYCQQRSNWPPWTFGQGTKVEIKRT

SEQ ID NO: 320 - protein, 110 aa, Artificial Sequence; identical to SEQ ID NO: 292
  Description of Artificial Sequence: Synthetic polypeptide
  L6_IGKJ1*01 S30W

SEQ ID NO: 321 - protein, 110 aa, Artificial Sequence
  Description of Artificial Sequence: Synthetic polypeptide
  L6_IGKJ1*01 S30Y
EIVLTQSPATLSLSPGERATLSCRASQSVYSYLAWYQQKPGQAPRLLIYDASNRATGIPARFSGSGSGTDFTLTISSLEPEDFAVYYCQQRSNWPPWTFGQGTKVEIKRT

SEQ ID NO: 322 - protein, 110 aa, Artificial Sequence
  Description of Artificial Sequence: Synthetic polypeptide
  L6_IGKJ1*01 S30Q
EIVLTQSPATLSLSPGERATLSCRASQSVQSYLAWYQQKPGQAPRLLIYDASNRATGIPARFSGSGSGTDFTLTISSLEPEDFAVYYCQQRSNWPPWTFGQGTKVEIKRT

SEQ ID NO: 323 - protein, 110 aa, Artificial Sequence
  Description of Artificial Sequence: Synthetic polypeptide
  L6_IGKJ1*01 S30A
EIVLTQSPATLSLSPGERATLSCRASQSVASYLAWYQQKPGQAPRLLIYDASNRATGIPARFSGSGSGTDFTLTISSLEPEDFAVYYCQQRSNWPPWTFGQGTKVEIKRT

SEQ ID NO: 324 - protein, 110 aa, Artificial Sequence
  Description of Artificial Sequence: Synthetic polypeptide
  L6_IGKJ1*01 S30G
EIVLTQSPATLSLSPGERATLSCRASQSVGSYLAWYQQKPGQAPRLLIYDASNRATGIPARFSGSGSGTDFTLTISSLEPEDFAVYYCQQRSNWPPWTFGQGTKVEIKRT

SEQ ID NO: 325 - protein, 110 aa, Artificial Sequence
  Description of Artificial Sequence: Synthetic polypeptide
  L6_IGKJ1*01 S30V
EIVLTQSPATLSLSPGERATLSCRASQSVVSYLAWYQQKPGQAPRLLIYDASNRATGIPARFSGSGSGTDFTLTISSLEPEDFAVYYCQQRSNWPPWTFGQGTKVEIKRT

SEQ ID NO: 326 - protein, 110 aa, Artificial Sequence
  Description of Artificial Sequence: Synthetic polypeptide
  L6_IGKJ1*01 S31T
EIVLTQSPATLSLSPGERATLSCRASQSVSTYLAWYQQKPGQAPRLLIYDASNRATGIPARFSGSGSGTDFTLTISSLEPEDFAVYYCQQRSNWPPWTFGQGTKVEIKRT

SEQ ID NO: 327 - protein, 110 aa, Artificial Sequence
  Description of Artificial Sequence: Synthetic polypeptide
  L6_IGKJ1*01 S31N
EIVLTQSPATLSLSPGERATLSCRASQSVSNYLAWYQQKPGQAPRLLIYDASNRATGIPARFSGSGSGTDFTLTISSLEPEDFAVYYCQQRSNWPPWTFGQGTKVEIKRT

SEQ ID NO: 328 - protein, 110 aa, Artificial Sequence
  Description of Artificial Sequence: Synthetic polypeptide
  L6_IGKJ1*01 S31L
EIVLTQSPATLSLSPGERATLSCRASQSVSLYLAWYQQKPGQAPRLLIYDASNRATGIPARFSGSGSGTDFTLTISSLEPEDFAVYYCQQRSNWPPWTFGQGTKVEIKRT

SEQ ID NO: 329 - protein, 110 aa, Artificial Sequence
  Description of Artificial Sequence: Synthetic polypeptide
  L6_IGKJ1*01 S31M
EIVLTQSPATLSLSPGERATLSCRASQSVSMYLAWYQQKPGQAPRLLIYDASNRATGIPARFSGSGSGTDFTLTISSLEPEDFAVYYCQQRSNWPPWTFGQGTKVEIKRT

SEQ ID NO: 330 - protein, 110 aa, Artificial Sequence
  Description of Artificial Sequence: Synthetic polypeptide
  L6_IGKJ1*01 S31F
EIVLTQSPATLSLSPGERATLSCRASQSVSFYLAWYQQKPGQAPRLLIYDASNRATGIPARFSGSGSGTDFTLTISSLEPEDFAVYYCQQRSNWPPWTFGQGTKVEIKRT

SEQ ID NO: 331 - protein, 110 aa, Artificial Sequence
  Description of Artificial Sequence: Synthetic polypeptide
  L6_IGKJ1*01 S31I
EIVLTQSPATLSLSPGERATLSCRASQSVSIYLAWYQQKPGQAPRLLIYDASNRATGIPARFSGSGSGTDFTLTISSLEPEDFAVYYCQQRSNWPPWTFGQGTKVEIKRT

SEQ ID NO: 332 - protein, 110 aa, Artificial Sequence
  Description of Artificial Sequence: Synthetic polypeptide
  L6_IGKJ1*01 S31V
EIVLTQSPATLSLSPGERATLSCRASQSVSVYLAWYQQKPGQAPRLLIYDASNRATGIPARFSGSGSGTDFTLTISSLEPEDFAVYYCQQRSNWPPWTFGQGTKVEIKRT

SEQ ID NO: 333 - protein, 110 aa, Artificial Sequence
  Description of Artificial Sequence: Synthetic polypeptide
  L6_IGKJ1*01 S31H
EIVLTQSPATLSLSPGERATLSCRASQSVSHYLAWYQQKPGQAPRLLIYDASNRATGIPARFSGSGSGTDFTLTISSLEPEDFAVYYCQQRSNWPPWTFGQGTKVEIKRT

SEQ ID NO: 334 - protein, 110 aa, Artificial Sequence
  Description of Artificial Sequence: Synthetic polypeptide
  L6_IGKJ1*01 S31A
EIVLTQSPATLSLSPGERATLSCRASQSVSAYLAWYQQKPGQAPRLLIYDASNRATGIPARFSGSGSGTDFTLTISSLEPEDFAVYYCQQRSNWPPWTFGQGTKVEIKRT

SEQ ID NO: 335 - protein, 110 aa, Artificial Sequence
  Description of Artificial Sequence: Synthetic polypeptide
  L6_IGKJ1*01 S31P
EIVLTQSPATLSLSPGERATLSCRASQSVSPYLAWYQQKPGQAPRLLIYDASNRATGIPARFSGSGSGTDFTLTISSLEPEDFAVYYCQQRSNWPPWTFGQGTKVEIKRT

SEQ ID NO: 336 - protein, 110 aa, Artificial Sequence
  Description of Artificial Sequence: Synthetic polypeptide
  L6_IGKJ1*01 S31D
EIVLTQSPATLSLSPGERATLSCRASQSVSDYLAWYQQKPGQAPRLLIYDASNRATGIPARFSGSGSGTDFTLTISSLEPEDFAVYYCQQRSNWPPWTFGQGTKVEIKRT

SEQ ID NO: 337 - protein, 110 aa, Artificial Sequence
  Description of Artificial Sequence: Synthetic polypeptide
  L6_IGKJ1*01 S31R
EIVLTQSPATLSLSPGERATLSCRASQSVSRYLAWYQQKPGQAPRLLIYDASNRATGIPARFSGSGSGTDFTLTISSLEPEDFAVYYCQQRSNWPPWTFGQGTKVEIKRT

SEQ ID NO: 338 - protein, 110 aa, Artificial Sequence
  Description of Artificial Sequence: Synthetic polypeptide
  L6_IGKJ1*01 S31Y
EIVLTQSPATLSLSPGERATLSCRASQSVSYYLAWYQQKPGQAPRLLIYDASNRATGIPARFSGSGSGTDFTLTISSLEPEDFAVYYCQQRSNWPPWTFGQGTKVEIKRT

SEQ ID NO: 339 - protein, 110 aa, Artificial Sequence
  Description of Artificial Sequence: Synthetic polypeptide
  L6_IGKJ1*01 S31Q
EIVLTQSPATLSLSPGERATLSCRASQSVSQYLAWYQQKPGQAPRLLIYDASNRATGIPARFSGSGSGTDFTLTISSLEPEDFAVYYCQQRSNWPPWTFGQGTKVEIKRT

SEQ ID NO: 340 - protein, 110 aa, Artificial Sequence
  Description of Artificial Sequence: Synthetic polypeptide
  L6_IGKJ1*01 S31E
EIVLTQSPATLSLSPGERATLSCRASQSVSEYLAWYQQKPGQAPRLLIYDASNRATGIPARFSGSGSGTDFTLTISSLEPEDFAVYYCQQRSNWPPWTFGQGTKVEIKRT

SEQ ID NO: 341 - protein, 110 aa, Artificial Sequence
  Description of Artificial Sequence: Synthetic polypeptide
  L6_IGKJ1*01 S31G
EIVLTQSPATLSLSPGERATLSCRASQSVSGYLAWYQQKPGQAPRLLIYDASNRATGIPARFSGSGSGTDFTLTISSLEPEDFAVYYCQQRSNWPPWTFGQGTKVEIKRT

SEQ ID NO: 342 - protein, 110 aa, Artificial Sequence
  Description of Artificial Sequence: Synthetic polypeptide
  L6_IGKJ1*01 S28P/S30N/S31K
EIVLTQSPATLSLSPGERATLSCRASQPVNKYLAWYQQKPGQAPRLLIYDASNRATGIPARFSGSGSGTDFTLTISSLEPEDFAVYYCQQRSNWPPWTFGQGTKVEIKRT

SEQ ID NO: 343 - protein, 110 aa, Artificial Sequence
  Description of Artificial Sequence: Synthetic polypeptide
  L6_IGKJ1*01 S28N/S30D/S31H
EIVLTQSPATLSLSPGERATLSCRASQNVDHYLAWYQQKPGQAPRLLIYDASNRATGIPARFSGSGSGTDFTLTISSLEPEDFAVYYCQQRSNWPPWTFGQGTKVEIKRT

SEQ ID NO: 344 - protein, 110 aa, Artificial Sequence
  Description of Artificial Sequence: Synthetic polypeptide
  L6_IGKJ1*01 D50A
EIVLTQSPATLSLSPGERATLSCRASQSVSSYLAWYQQKPGQAPRLLIYAASNRATGIPARFSGSGSGTDFTLTISSLEPEDFAVYYCQQRSNWPPWTFGQGTKVEIKRT

SEQ ID NO: 345 - protein, 110 aa, Artificial Sequence
  Description of Artificial Sequence: Synthetic polypeptide
  L6_IGKJ1*01 A51T
EIVLTQSPATLSLSPGERATLSCRASQSVSSYLAWYQQKPGQAPRLLIYDTSNRATGIPARFSGSGSGTDFTLTISSLEPEDFAVYYCQQRSNWPPWTFGQGTKVEIKRT

SEQ ID NO: 346 - protein, 110 aa, Artificial Sequence
  Description of Artificial Sequence: Synthetic polypeptide
  L6_IGKJ1*01 S52A
EIVLTQSPATLSLSPGERATLSCRASQSVSSYLAWYQQKPGQAPRLLIYDAANRATGIPARFSGSGSGTDFTLTISSLEPEDFAVYYCQQRSNWPPWTFGQGTKVEIKRT

SEQ ID NO: 347 - protein, 110 aa, Artificial Sequence
  Description of Artificial Sequence: Synthetic polypeptide
  L6_IGKJ1*01 N53A
EIVLTQSPATLSLSPGERATLSCRASQSVSSYLAWYQQKPGQAPRLLIYDASARATGIPARFSGSGSGTDFTLTISSLEPEDFAVYYCQQRSNWPPWTFGQGTKVEIKRT

SEQ ID NO: 348 - protein, 110 aa, Artificial Sequence
  Description of Artificial Sequence: Synthetic polypeptide
  L6_IGKJ1*01 R54A
EIVLTQSPATLSLSPGERATLSCRASQSVSSYLAWYQQKPGQAPRLLIYDASNAATGIPARFSGSGSGTDFTLTISSLEPEDFAVYYCQQRSNWPPWTFGQGTKVEIKRT

SEQ ID NO: 349 - protein, 110 aa, Artificial Sequence
  Description of Artificial Sequence: Synthetic polypeptide
  L6_IGKJ1*01 A55T
EIVLTQSPATLSLSPGERATLSCRASQSVSSYLAWYQQKPGQAPRLLIYDASNRTTGIPARFSGSGSGTDFTLTISSLEPEDFAVYYCQQRSNWPPWTFGQGTKVEIKRT

SEQ ID NO: 350 - protein, 110 aa, Artificial Sequence
  Description of Artificial Sequence: Synthetic polypeptide
  L6_IGKJ1*01 T56A
EIVLTQSPATLSLSPGERATLSCRASQSVSSYLAWYQQKPGQAPRLLIYDASNRAAGIPARFSGSGSGTDFTLTISSLEPEDFAVYYCQQRSNWPPWTFGQGTKVEIKRT

SEQ ID NO: 351 - protein, 110 aa, Artificial Sequence
  Description of Artificial Sequence: Synthetic polypeptide
  L6_IGKJ1*01 S28N/S30D/S31H S52L
EIVLTQSPATLSLSPGERATLSCRASQNVDHYLAWYQQKPGQAPRLLIYDALNRATGIPARFSGSGSGTDFTLTISSLEPEDFAVYYCQQRSNWPPWTFGQGTKVEIKRT

SEQ ID NO: 352 - protein, 110 aa, Artificial Sequence
  Description of Artificial Sequence: Synthetic polypeptide
  L6_IGKJ1*01 S28N/S30D/S31H S52T
EIVLTQSPATLSLSPGERATLSCRASQNVDHYLAWYQQKPGQAPRLLIYDATNRATGIPARFSGSGSGTDFTLTISSLEPEDFAVYYCQQRSNWPPWTFGQGTKVEIKRT

SEQ ID NO: 353 - protein, 110 aa, Artificial Sequence
  Description of Artificial Sequence: Synthetic polypeptide
  L6_IGKJ1*01 S28N/S30D/S31H S52R
EIVLTQSPATLSLSPGERATLSCRASQNVDHYLAWYQQKPGQAPRLLIYDARNRATGIPARFSGSGSGTDFTLTISSLEPEDFAVYYCQQRSNWPPWTFGQGTKVEIKRT

SEQ ID NO: 354 - protein, 110 aa, Artificial Sequence
  Description of Artificial Sequence: Synthetic polypeptide
  L6_IGKJ1*01 S28N/S30D/S31H S52W
EIVLTQSPATLSLSPGERATLSCRASQNVDHYLAWYQQKPGQAPRLLIYDAWNRATGIPARFSGSGSGTDFTLTISSLEPEDFAVYYCQQRSNWPPWTFGQGTKVEIKRT

SEQ ID NO: 355 - protein, 110 aa, Artificial Sequence
  Description of Artificial Sequence: Synthetic polypeptide
  L6_IGKJ1*01 S28N/S30D/S31H S52N
EIVLTQSPATLSLSPGERATLSCRASQNVDHYLAWYQQKPGQAPRLLIYDANNRATGIPARFSGSGSGTDFTLTISSLEPEDFAVYYCQQRSNWPPWTFGQGTKVEIKRT

SEQ ID NO: 356 - protein, 110 aa, Artificial Sequence
  Description of Artificial Sequence: Synthetic polypeptide
  L6_IGKJ1*01 S28N/S30D/S31H S52P
EIVLTQSPATLSLSPGERATLSCRASQNVDHYLAWYQQKPGQAPRLLIYDAPNRATGIPARFSGSGSGTDFTLTISSLEPEDFAVYYCQQRSNWPPWTFGQGTKVEIKRT

SEQ ID NO: 357 - protein, 110 aa, Artificial Sequence
  Description of Artificial Sequence: Synthetic polypeptide
  L6_IGKJ1*01 S28N/S30D/S31H S52M
EIVLTQSPATLSLSPGERATLSCRASQNVDHYLAWYQQKPGQAPRLLIYDAMNRATGIPARFSGSGSGTDFTLTISSLEPEDFAVYYCQQRSNWPPWTFGQGTKVEIKRT

SEQ ID NO: 358 - protein, 110 aa, Artificial Sequence
  Description of Artificial Sequence: Synthetic polypeptide
  L6_IGKJ1*01 S28N/S30D/S31H N53E
EIVLTQSPATLSLSPGERATLSCRASQNVDHYLAWYQQKPGQAPRLLIYDASERATGIPARFSGSGSGTDFTLTISSLEPEDFAVYYCQQRSNWPPWTFGQGTKVEIKRT

SEQ ID NO: 359 - protein, 110 aa, Artificial Sequence
  Description of Artificial Sequence: Synthetic polypeptide
  L6_IGKJ1*01 S28N/S30D/S31H N53G
EIVLTQSPATLSLSPGERATLSCRASQNVDHYLAWYQQKPGQAPRLLIYDASGRATGIPARFSGSGSGTDFTLTISSLEPEDFAVYYCQQRSNWPPWTFGQGTKVEIKRT

SEQ ID NO: 360 - protein, 110 aa, Artificial Sequence
  Description of Artificial Sequence: Synthetic polypeptide
  L6_IGKJ1*01 S28N/S30D/S31H N53M
EIVLTQSPATLSLSPGERATLSCRASQNVDHYLAWYQQKPGQAPRLLIYDASMRATGIPARFSGSGSGTDFTLTISSLEPEDFAVYYCQQRSNWPPWTFGQGTKVEIKRT

SEQ ID NO: 361 - protein, 110 aa, Artificial Sequence
  Description of Artificial Sequence: Synthetic polypeptide
  L6_IGKJ1*01 S28N/S30D/S31H N53C
EIVLTQSPATLSLSPGERATLSCRASQNVDHYLAWYQQKPGQAPRLLIYDASCRATGIPARFSGSGSGTDFTLTISSLEPEDFAVYYCQQRSNWPPWTFGQGTKVEIKRT

SEQ ID NO: 362 - protein, 110 aa, Artificial Sequence
  Description of Artificial Sequence: Synthetic polypeptide
  L6_IGKJ1*01 S28N/S30D/S31H N53H
EIVLTQSPATLSLSPGERATLSCRASQNVDHYLAWYQQKPGQAPRLLIYDASHRATGIPARFSGSGSGTDFTLTISSLEPEDFAVYYCQQRSNWPPWTFGQGTKVEIKRT

SEQ ID NO: 363 - protein, 110 aa, Artificial Sequence
  Description of Artificial Sequence: Synthetic polypeptide
  L6_IGKJ1*01 S28N/S30D/S31H N53P
EIVLTQSPATLSLSPGERATLSCRASQNVDHYLAWYQQKPGQAPRLLIYDASPRATGIPARFSGSGSGTDFTLTISSLEPEDFAVYYCQQRSNWPPWTFGQGTKVEIKRT

SEQ ID NO: 364 - protein, 110 aa, Artificial Sequence
  Description of Artificial Sequence: Synthetic polypeptide
  L6_IGKJ1*01 S28N/S30D/S31H N53A
EIVLTQSPATLSLSPGERATLSCRASQNVDHYLAWYQQKPGQAPRLLIYDASARATGIPARFSGSGSGTDFTLTISSLEPEDFAVYYCQQRSNWPPWTFGQGTKVEIKRT

SEQ ID NO: 365 - protein, 110 aa, Artificial Sequence
  Description of Artificial Sequence: Synthetic polypeptide
  L6_IGKJ1*01 S28N/S30D/S31H A55R
EIVLTQSPATLSLSPGERATLSCRASQNVDHYLAWYQQKPGQAPRLLIYDASNRRTGIPARFSGSGSGTDFTLTISSLEPEDFAVYYCQQRSNWPPWTFGQGTKVEIKRT

SEQ ID NO: 366 - protein, 110 aa, Artificial Sequence
  Description of Artificial Sequence: Synthetic polypeptide
  L6_IGKJ1*01 S28N/S30D/S31H A55C
EIVLTQSPATLSLSPGERATLSCRASQNVDHYLAWYQQKPGQAPRLLIYDASNRCTGIPARFSGSGSGTDFTLTISSLEPEDFAVYYCQQRSNWPPWTFGQGTKVEIKRT

SEQ ID NO: 367 - protein, 110 aa, Artificial Sequence
  Description of Artificial Sequence: Synthetic polypeptide
  L6_IGKJ1*01 S28N/S30D/S31H A55S
EIVLTQSPATLSLSPGERATLSCRASQNVDHYLAWYQQKPGQAPRLLIYDASNRSTGIPARFSGSGSGTDFTLTISSLEPEDFAVYYCQQRSNWPPWTFGQGTKVEIKRT

SEQ ID NO: 368 - protein, 110 aa, Artificial Sequence; identical to SEQ ID NO: 343
  Description of Artificial Sequence: Synthetic polypeptide
  L6_IGKJ1*01 S28N/S30D/S31H A55G

SEQ ID NO: 369 - protein, 110 aa, Artificial Sequence
  Description of Artificial Sequence: Synthetic polypeptide
  L6_IGKJ1*01 S28N/S30D/S31H S52L/A55G
EIVLTQSPATLSLSPGERATLSCRASQNVDHYLAWYQQKPGQAPRLLIYDALNRGTGIPARFSGSGSGTDFTLTISSLEPEDFAVYYCQQRSNWPPWTFGQGTKVEIKRT

SEQ ID NO: 370 - protein, 110 aa, Artificial Sequence
  Description of Artificial Sequence: Synthetic polypeptide
  L6_IGKJ1*01 S28N/S30D/S31H S52L/A55S
EIVLTQSPATLSLSPGERATLSCRASQNVDHYLAWYQQKPGQAPRLLIYDALNRSTGIPARFSGSGSGTDFTLTISSLEPEDFAVYYCQQRSNWPPWTFGQGTKVEIKRT

SEQ ID NO: 371 - protein, 110 aa, Artificial Sequence
  Description of Artificial Sequence: Synthetic polypeptide
  L6_IGKJ1*01 S76L
EIVLTQSPATLSLSPGERATLSCRASQSVSSYLAWYQQKPGQAPRLLIYDASNRATGIPARFSGSGSGTDFTLTILSLEPEDFAVYYCQQRSNWPPWTFGQGTKVEIKRT

SEQ ID NO: 372 - protein, 110 aa, Artificial Sequence
  Description of Artificial Sequence: Synthetic polypeptide
  L6_IGKJ1*01 S76T
EIVLTQSPATLSLSPGERATLSCRASQSVSSYLAWYQQKPGQAPRLLIYDASNRATGIPARFSGSGSGTDFTLTITSLEPEDFAVYYCQQRSNWPPWTFGQGTKVEIKRT

SEQ ID NO: 373 - protein, 110 aa, Artificial Sequence
  Description of Artificial Sequence: Synthetic polypeptide
  L6_IGKJ1*01 S76G
EIVLTQSPATLSLSPGERATLSCRASQSVSSYLAWYQQKPGQAPRLLIYDASNRATGIPARFSGSGSGTDFTLTIGSLEPEDFAVYYCQQRSNWPPWTFGQGTKVEIKRT

SEQ ID NO: 374 - protein, 110 aa, Artificial Sequence
  Description of Artificial Sequence: Synthetic polypeptide
  L6_IGKJ1*01 S76A
EIVLTQSPATLSLSPGERATLSCRASQSVSSYLAWYQQKPGQAPRLLIYDASNRATGIPARFSGSGSGTDFTLTIASLEPEDFAVYYCQQRSNWPPWTFGQGTKVEIKRT

SEQ ID NO: 375 - protein, 110 aa, Artificial Sequence
  Description of Artificial Sequence: Synthetic polypeptide
  L6_IGKJ1*01 S76Y
EIVLTQSPATLSLSPGERATLSCRASQSVSSYLAWYQQKPGQAPRLLIYDASNRATGIPARFSGSGSGTDFTLTIYSLEPEDFAVYYCQQRSNWPPWTFGQGTKVEIKRT

SEQ ID NO: 376 - protein, 110 aa, Artificial Sequence
  Description of Artificial Sequence: Synthetic polypeptide
  L6_IGKJ1*01 F62L
EIVLTQSPATLSLSPGERATLSCRASQSVSSYLAWYQQKPGQAPRLLIYDASNRATGIPARLSGSGSGTDFTLTISSLEPEDFAVYYCQQRSNWPPWTFGQGTKVEIKRT

SEQ ID NO: 377 - protein, 110 aa, Artificial Sequence
  Description of Artificial Sequence: Synthetic polypeptide
  L6_IGKJ1*01 S76E
EIVLTQSPATLSLSPGERATLSCRASQSVSSYLAWYQQKPGQAPRLLIYDASNRATGIPARFSGSGSGTDFTLTIESLEPEDFAVYYCQQRSNWPPWTFGQGTKVEIKRT

SEQ ID NO: 378 - protein, 110 aa, Artificial Sequence
  Description of Artificial Sequence: Synthetic polypeptide
  L6_IGKJ1*01 S76Q
EIVLTQSPATLSLSPGERATLSCRASQSVSSYLAWYQQKPGQAPRLLIYDASNRATGIPARFSGSGSGTDFTLTIQSLEPEDFAVYYCQQRSNWPPWTFGQGTKVEIKRT

SEQ ID NO: 379 - protein, 110 aa, Artificial Sequence
  Description of Artificial Sequence: Synthetic polypeptide
  L6_IGKJ1*01 S76P
EIVLTQSPATLSLSPGERATLSCRASQSVSSYLAWYQQKPGQAPRLLIYDASNRATGIPARFSGSGSGTDFTLTIPSLEPEDFAVYYCQQRSNWPPWTFGQGTKVEIKRT

SEQ ID NO: 380 - protein, 110 aa, Artificial Sequence
  Description of Artificial Sequence: Synthetic polypeptide
  L6_IGKJ1*01 S76N
EIVLTQSPATLSLSPGERATLSCRASQSVSSYLAWYQQKPGQAPRLLIYDASNRATGIPARFSGSGSGTDFTLTINSLEPEDFAVYYCQQRSNWPPWTFGQGTKVEIKRT

SEQ ID NO: 381 - protein, 123 aa, Artificial Sequence
  Description of Artificial Sequence: Synthetic polypeptide
  VH5-51_IGHD5-18*01>3_IGHJ4*01 G100K
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARRKYSYGYDYFDYWGQGTLVTVSSAS

SEQ ID NO: 382 - protein, 123 aa, Artificial Sequence
  Description of Artificial Sequence: Synthetic polypeptide
  VH5-51_IGHD5-18*01>3_IGHJ4*01 G100R
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARRRYSYGYDYFDYWGQGTLVTVSSAS

SEQ ID NO: 383 - protein, 123 aa, Artificial Sequence
  Description of Artificial Sequence: Synthetic polypeptide
  VH5-51_IGHD5-18*01>3_IGHJ4*01 G104T
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARRGYSYTYDYFDYWGQGTLVTVSSAS

SEQ ID NO: 384 - protein, 123 aa, Artificial Sequence
  Description of Artificial Sequence: Synthetic polypeptide
  VH5-51_IGHD5-18*01>3_IGHJ4*01 G100K/G104T
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARRKYSYTYDYFDYWGQGTLVTVSSAS

SEQ ID NO: 385 - protein, 123 aa, Artificial Sequence
  Description of Artificial Sequence: Synthetic polypeptide
  VH5-51_IGHD5-18*01>3_IGHJ4*01 R99A
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARAGYSYGYDYFDYWGQGTLVTVSSAS

SEQ ID NO: 386 - protein, 123 aa, Artificial Sequence
  Description of Artificial Sequence: Synthetic polypeptide
  VH5-51_IGHD5-18*01>3_IGHJ4*01 G100A
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARRAYSYGYDYFDYWGQGTLVTVSSAS

SEQ ID NO: 387 - protein, 123 aa, Artificial Sequence
  Description of Artificial Sequence: Synthetic polypeptide
  VH5-51_IGHD5-18*01>3_IGHJ4*01 Y101A
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARRGASYGYDYFDYWGQGTLVTVSSAS

SEQ ID NO: 388 - protein, 123 aa, Artificial Sequence
  Description of Artificial Sequence: Synthetic polypeptide
  VH5-51_IGHD5-18*01>3_IGHJ4*01 S102A
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARRGYAYGYDYFDYWGQGTLVTVSSAS

SEQ ID NO: 389 - protein, 123 aa, Artificial Sequence
  Description of Artificial Sequence: Synthetic polypeptide
  VH5-51_IGHD5-18*01>3_IGHJ4*01 Y103A
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARRGYSAGYDYFDYWGQGTLVTVSSAS

SEQ ID NO: 390 - protein, 123 aa, Artificial Sequence
  Description of Artificial Sequence: Synthetic polypeptide
  VH5-51_IGHD5-18*01>3_IGHJ4*01 G104A
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARRGYSYAYDYFDYWGQGTLVTVSSAS

SEQ ID NO: 391 - protein, 123 aa, Artificial Sequence
  Description of Artificial Sequence: Synthetic polypeptide
  VH5-51_IGHD5-18*01>3_IGHJ4*01 Y105A
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARRGYSYGADYFDYWGQGTLVTVSSAS

SEQ ID NO: 392 - protein, 123 aa, Artificial Sequence
  Description of Artificial Sequence: Synthetic polypeptide
  VH5-51_IGHD5-18*01>3_IGHJ4*01 D106A
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARRGYSYGYAYFDYWGQGTLVTVSSAS

SEQ ID NO: 393 - protein, 123 aa, Artificial Sequence
  Description of Artificial Sequence: Synthetic polypeptide
  VH5-51_IGHD5-18*01>3_IGHJ4*01 G100L
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARRLYSYGYDYFDYWGQGTLVTVSSAS

SEQ ID NO: 394 - protein, 123 aa, Artificial Sequence
  Description of Artificial Sequence: Synthetic polypeptide
  VH5-51_IGHD5-18*01>3_IGHJ4*01 G100D
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARRDYSYGYDYFDYWGQGTLVTVSSAS

SEQ ID NO: 395 - protein, 123 aa, Artificial Sequence
  Description of Artificial Sequence: Synthetic polypeptide
  VH5-51_IGHD5-18*01>3_IGHJ4*01 G100T
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARRTYSYGYDYFDYWGQGTLVTVSSAS

SEQ ID NO: 396 - protein, 123 aa, Artificial Sequence
  Description of Artificial Sequence: Synthetic polypeptide
  VH5-51_IGHD5-18*01>3_IGHJ4*01 G104D
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARRGYSYDYDYFDYWGQGTLVTVSSAS

SEQ ID NO: 397 - protein, 123 aa, Artificial Sequence
  Description of Artificial Sequence: Synthetic polypeptide
  VH5-51_IGHD5-18*01>3_IGHJ4*01 G104L
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARRGYSYLYDYFDYWGQGTLVTVSSAS

SEQ ID NO: 398 - protein, 123 aa, Artificial Sequence
  Description of Artificial Sequence: Synthetic polypeptide
  VH5-51_IGHD5-18*01>3_IGHJ4*01 G104P
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARRGYSYPYDYFDYWGQGTLVTVSSAS

SEQ ID NO: 399 - protein, 123 aa, Artificial Sequence
  Description of Artificial Sequence: Synthetic polypeptide
  VH5-51_IGHD5-18*01>3_IGHJ4*01 G104R
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARRGYSYRYDYFDYWGQGTLVTVSSAS

SEQ ID NO: 400 - protein, 123 aa, Artificial Sequence
  Description of Artificial Sequence: Synthetic polypeptide
  VH5-51_IGHD5-18*01>3_IGHJ4*01 G104M
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARRGYSYMYDYFDYWGQGTLVTVSSAS

SEQ ID NO: 401 - protein, 123 aa, Artificial Sequence
  Description of Artificial Sequence: Synthetic polypeptide
  VH5-51_IGHD5-18*01>3_IGHJ4*01 G104K
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARRGYSYKYDYFDYWGQGTLVTVSSAS

SEQ ID NO: 402 - protein, 123 aa, Artificial Sequence
  Description of Artificial Sequence: Synthetic polypeptide
  VH5-51_IGHD5-18*01>3_IGHJ4*01 G104S
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARRGYSYSYDYFDYWGQGTLVTVSSAS

SEQ ID NO: 403 - protein, 123 aa, Artificial Sequence
  Description of Artificial Sequence: Synthetic polypeptide
  VH5-51_IGHD5-18*01>3_IGHJ4*01 G104R/Y101H
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARRGHSYRYDYFDYWGQGTLVTVSSAS

SEQ ID NO: 404 - protein, 123 aa, Artificial Sequence
  Description of Artificial Sequence: Synthetic polypeptide
  VH5-51_IGHD5-18*01>3_IGHJ4*01 G100K/G104T G24A
EVQLVQSGAEVKKPGESLKISCKASGYSFTSYWIGWVRQMPGKGLEWMGIIYPGDSDTRYSPSFQGQVTISADKSISTAYLQWSSLKASDTAMYYCARRKYSYTYDYFDYWGQGTLVTVSSAS

SEQ ID NO: 405 - protein, 123 aa, Artificial Sequence
  Description of Artificial Sequence: Synthetic polypeptide
  VH5-51_IGHD5-18*01>3_IGHJ4*01 G100K/G104T I34A
EVQLVQSGAEVKKPGESLKISCKGSGYSFTSYWAGWVRQMPGKGLEWMGIIYPGDSDTRYSPSFQGQVTISADKSISTAYLQWSSLKASDTAMYYCARRKYSYTYDYFDYWGQGTLVTVSSAS

SEQ ID NO: 406 - protein, 123 aa, Artificial Sequence
  Description of Artificial Sequence: Synthetic polypeptide
  VH5-51_IGHD5-18*01>3_IGHJ4*01 G100K/G104T G35A
EVQLVQSGAEVKKPGESLKISCKGSGYSFTSYWIAWVRQMPGKGLEWMGIIYPGDSDTRYSPSFQGQVTISADKSISTAYLQWSSLKASDTAMYYCARRKYSYTYDYFDYWGQGTLVTVSSAS

SEQ ID NO: 407 - protein, 123 aa, Artificial Sequence
  Description of Artificial Sequence: Synthetic polypeptide
  VH5-51_IGHD5-18*01>3_IGHJ4*01 G100K/G104T S28A
EVQLVQSGAEVKKPGESLKISCKGSGYAFTSYWIGWVRQMPGKGLEWMGIIYPGDSDTRYSPSFQGQVTISADKSISTAYLQWSSLKASDTAMYYCARRKYSYTYDYFDYWGQGTLVTVSSAS

SEQ ID NO: 408 - protein, 123 aa, Artificial Sequence
  Description of Artificial Sequence: Synthetic polypeptide
  VH5-51_IGHD5-18*01>3_IGHJ4*01 G100K/G104T F29A
EVQLVQSGAEVKKPGESLKISCKGSGYSATSYWIGWVRQMPGKGLEWMGIIYPGDSDTRYSPSFQGQVTISADKSISTAYLQWSSLKASDTAMYYCARRKYSYTYDYFDYWGQGTLVTVSSAS

SEQ ID NO: 409 - protein, 123 aa, Artificial Sequence
  Description of Artificial Sequence: Synthetic polypeptide
  VH5-51_IGHD5-18*01>3_IGHJ4*01 G100K/G104T T30A
EVQLVQSGAEVKKPGESLKISCKGSGYSFASYWIGWVRQMPGKGLEWMGIIYPGDSDTRYSPSFQGQVTISADKSISTAYLQWSSLKASDTAMYYCARRKYSYTYDYFDYWGQGTLVTVSSAS

SEQ ID NO: 410 - protein, 123 aa, Artificial Sequence
  Description of Artificial Sequence: Synthetic polypeptide
  VH5-51_IGHD5-18*01>3_IGHJ4*01 G100K/G104T W33A
EVQLVQSGAEVKKPGESLKISCKGSGYSFTSYAIGWVRQMPGKGLEWMGIIYPGDSDTRYSPSFQGQVTISADKSISTAYLQWSSLKASDTAMYYCARRKYSYTYDYFDYWGQGTLVTVSSAS

SEQ ID NO: 411 - protein, 123 aa, Artificial Sequence
  Description of Artificial Sequence: Synthetic polypeptide
  VH5-51_IGHD5-18*01>3_IGHJ4*01 G100K/G104T G24L
EVQLVQSGAEVKKPGESLKISCKLSGYSFTSYWIGWVRQMPGKGLEWMGIIYPGDSDTRYSPSFQGQVTISADKSISTAYLQWSSLKASDTAMYYCARRKYSYTYDYFDYWGQGTLVTVSSAS

SEQ ID NO: 412 - protein, 123 aa, Artificial Sequence
  Description of Artificial Sequence: Synthetic polypeptide
  VH5-51_IGHD5-18*01>3_IGHJ4*01 G100K/G104T G24S
EVQLVQSGAEVKKPGESLKISCKSSGYSFTSYWIGWVRQMPGKGLEWMGIIYPGDSDTRYSPSFQGQVTISADKSISTAYLQWSSLKASDTAMYYCARRKYSYTYDYFDYWGQGTLVTVSSAS

SEQ ID NO: 413 - protein, 123 aa, Artificial Sequence
  Description of Artificial Sequence: Synthetic polypeptide
  VH5-51_IGHD5-18*01>3_IGHJ4*01 G100K/G104T G24R
EVQLVQSGAEVKKPGESLKISCKRSGYSFTSYWIGWVRQMPGKGLEWMGIIYPGDSDTRYSPSFQGQVTISADKSISTAYLQWSSLKASDTAMYYCARRKYSYTYDYFDYWGQGTLVTVSSAS

SEQ ID NO: 414 - protein, 123 aa, Artificial Sequence
  Description of Artificial Sequence: Synthetic polypeptide
  VH5-51_IGHD5-18*01>3_IGHJ4*01 G100K/G104T S28R
EVQLVQSGAEVKKPGESLKISCKGSGYRFTSYWIGWVRQMPGKGLEWMGIIYPGDSDTRYSPSFQGQVTISADKSISTAYLQWSSLKASDTAMYYCARRKYSYTYDYFDYWGQGTLVTVSSAS

SEQ ID NO: 415 - protein, 123 aa, Artificial Sequence
  Description of Artificial Sequence: Synthetic polypeptide
  VH5-51_IGHD5-18*01>3_IGHJ4*01 G100K/G104T S28K
EVQLVQSGAEVKKPGESLKISCKGSGYKFTSYWIGWVRQMPGKGLEWMGIIYPGDSDTRYSPSFQGQVTISADKSISTAYLQWSSLKASDTAMYYCARRKYSYTYDYFDYWGQGTLVTVSSAS

SEQ ID NO: 416 - protein, 123 aa, Artificial Sequence
  Description of Artificial Sequence: Synthetic polypeptide
  VH5-51_IGHD5-18*01>3_IGHJ4*01 G100K/G104T S28N
EVQLVQSGAEVKKPGESLKISCKGSGYNFTSYWIGWVRQMPGKGLEWMGIIYPGDSDTRYSPSFQGQVTISADKSISTAYLQWSSLKASDTAMYYCARRKYSYTYDYFDYWGQGTLVTVSSAS

SEQ ID NO: 417 - protein, 123 aa, Artificial Sequence
  Description of Artificial Sequence: Synthetic polypeptide
  VH5-51_IGHD5-18*01>3_IGHJ4*01 G100K/G104T G35T
EVQLVQSGAEVKKPGESLKISCKGSGYSFTSYWITWVRQMPGKGLEWMGIIYPGDSDTRYSPSFQGQVTISADKSISTAYLQWSSLKASDTAMYYCARRKYSYTYDYFDYWGQGTLVTVSSAS

SEQ ID NO: 418 - protein, 123 aa, Artificial Sequence; identical to SEQ ID NO: 406
  Description of Artificial Sequence: Synthetic polypeptide
  VH5-51_IGHD5-18*01>3_IGHJ4*01 G100K/G104T G35A

SEQ ID NO: 419 - protein, 123 aa, Artificial Sequence
  Description of Artificial Sequence: Synthetic polypeptide
  VH5-51_IGHD5-18*01>3_IGHJ4*01 G100K/G104T G35V
EVQLVQSGAEVKKPGESLKISCKGSGYSFTSYWIVWVRQMPGKGLEWMGIIYPGDSDTRYSPSFQGQVTISADKSISTAYLQWSSLKASDTAMYYCARRKYSYTYDYFDYWGQGTLVTVSSAS

SEQ ID NO: 420 - protein, 123 aa, Artificial Sequence
  Description of Artificial Sequence: Synthetic polypeptide
  VH5-51_IGHD5-18*01>3_IGHJ4*01 G100K/G104T G24L/S28R/G35V
EVQLVQSGAEVKKPGESLKISCKLSGYRFTSYWIVWVRQMPGKGLEWMGIIYPGDSDTRYSPSFQGQVTISADKSISTAYLQWSSLKASDTAMYYCARRKYSYTYDYFDYWGQGTLVTVSSAS

SEQ ID NO: 421 - protein, 123 aa, Artificial Sequence
  Description of Artificial Sequence: Synthetic polypeptide
  VH5-51_IGHD5-18*01>3_IGHJ4*01 G100K/G104T D57A
EVQLVQSGAEVKKPGESLKISCKGSGYSFTSYWIGWVRQMPGKGLEWMGIIYPGDSATRYSPSFQGQVTISADKSISTAYLQWSSLKASDTAMYYCARRKYSYTYDYFDYWGQGTLVTVSSAS

SEQ ID NO: 422 - protein, 123 aa, Artificial Sequence
  Description of Artificial Sequence: Synthetic polypeptide
  VH5-51_IGHD5-18*01>3_IGHJ4*01 G100K/G104T I50A
EVQLVQSGAEVKKPGESLKISCKGSGYSFTSYWIGWVRQMPGKGLEWMGAIYPGDSDTRYSPSFQGQVTISADKSISTAYLQWSSLKASDTAMYYCARRKYSYTYDYFDYWGQGTLVTVSSAS

SEQ ID NO: 423 - protein, 123 aa, Artificial Sequence
  Description of Artificial Sequence: Synthetic polypeptide
  VH5-51_IGHD5-18*01>3_IGHJ4*01 G100K/G104T I51A
EVQLVQSGAEVKKPGESLKISCKGSGYSFTSYWIGWVRQMPGKGLEWMGIAYPGDSDTRYSPSFQGQVTISADKSISTAYLQWSSLKASDTAMYYCARRKYSYTYDYFDYWGQGTLVTVSSAS

SEQ ID NO: 424 - protein, 123 aa, Artificial Sequence
  Description of Artificial Sequence: Synthetic polypeptide
  VH5-51_IGHD5-18*01>3_IGHJ4*01 G100K/G104T Y52A
EVQLVQSGAEVKKPGESLKISCKGSGYSFTSYWIGWVRQMPGKGLEWMGIIAPGDSDTRYSPSFQGQVTISADKSISTAYLQWSSLKASDTAMYYCARRKYSYTYDYFDYWGQGTLVTVSSAS

SEQ ID NO: 425 - protein, 123 aa, Artificial Sequence
  Description of Artificial Sequence: Synthetic polypeptide
  VH5-51_IGHD5-18*01>3_IGHJ4*01 G100K/G104T P53A
EVQLVQSGAEVKKPGESLKISCKGSGYSFTSYWIGWVRQMPGKGLEWMGIIYAGDSDTRYSPSFQGQVTISADKSISTAYLQWSSLKASDTAMYYCARRKYSYTYDYFDYWGQGTLVTVSSAS

SEQ ID NO: 426 - protein, 123 aa, Artificial Sequence
  Description of Artificial Sequence: Synthetic polypeptide
  VH5-51_IGHD5-18*01>3_IGHJ4*01 G100K/G104T D55A
EVQLVQSGAEVKKPGESLKISCKGSGYSFTSYWIGWVRQMPGKGLEWMGIIYPGASDTRYSPSFQGQVTISADKSISTAYLQWSSLKASDTAMYYCARRKYSYTYDYFDYWGQGTLVTVSSAS

SEQ ID NO: 427 - protein, 123 aa, Artificial Sequence
  Description of Artificial Sequence: Synthetic polypeptide
  VH5-51_IGHD5-18*01>3_IGHJ4*01 G100K/G104T T58D
EVQLVQSGAEVKKPGESLKISCKGSGYSFTSYWIGWVRQMPGKGLEWMGIIYPGDSDDRYSPSFQGQVTISADKSISTAYLQWSSLKASDTAMYYCARRKYSYTYDYFDYWGQGTLVTVSSAS

SEQ ID NO: 428 - protein, 123 aa, Artificial Sequence
  Description of Artificial Sequence: Synthetic polypeptide
  VH5-51_IGHD5-18*01>3_IGHJ4*01 G100K/G104T T58A
EVQLVQSGAEVKKPGESLKISCKGSGYSFTSYWIGWVRQMPGKGLEWMGIIYPGDSDARYSPSFQGQVTISADKSISTAYLQWSSLKASDTAMYYCARRKYSYTYDYFDYWGQGTLVTVSSAS

SEQ ID NO: 429 - protein, 123 aa, Artificial Sequence
  Description of Artificial Sequence: Synthetic polypeptide
  VH5-51_IGHD5-18*01>3_IGHJ4*01 G100K/G104T S56G
EVQLVQSGAEVKKPGESLKISCKGSGYSFTSYWIGWVRQMPGKGLEWMGIIYPGDGDTRYSPSFQGQVTISADKSISTAYLQWSSLKASDTAMYYCARRKYSYTYDYFDYWGQGTLVTVSSAS

SEQ ID NO: 430 - protein, 123 aa, Artificial Sequence
  Description of Artificial Sequence: Synthetic polypeptide
  VH5-51_IGHD5-18*01>3_IGHJ4*01 G100K/G104T S84V
EVQLVQSGAEVKKPGESLKISCKGSGYSFTSYWIGWVRQMPGKGLEWMGIIYPGDSDTRYSPSFQGQVTISADKSISTAYLQWVSLKASDTAMYYCARRKYSYTYDYFDYWGQGTLVTVSSAS

SEQ ID NO: 431 - protein, 123 aa, Artificial Sequence
  Description of Artificial Sequence: Synthetic polypeptide
  VH5-51_IGHD5-18*01>3_IGHJ4*01 G100K/G104T S84L
EVQLVQSGAEVKKPGESLKISCKGSGYSFTSYWIGWVRQMPGKGLEWMGIIYPGDSDTRYSPSFQGQVTISADKSISTAYLQWLSLKASDTAMYYCARRKYSYTYDYFDYWGQGTLVTVSSAS

SEQ ID NO: 432 - protein, 123 aa, Artificial Sequence
  Description of Artificial Sequence: Synthetic polypeptide
  VH5-51_IGHD5-18*01>3_IGHJ4*01 G100K/G104T D109A
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARRKYSYTYDYFAYWGQGTLVTVSSAS

SEQ ID NO: 433 - protein, 123 aa, Artificial Sequence
  Description of Artificial Sequence: Synthetic polypeptide
  VH5-51_IGHD5-18*01>3_IGHJ4*01 G100K/G104T G24T/S28R/G35V
EVQLVQSGAEVKKPGESLKISCKTSGYRFTSYWIVWVRQMPGKGLEWMGIIYPGDSDTRYSPSFQGQVTISADKSISTAYLQWSSLKASDTAMYYCARRKYSYTYDYFDYWGQGTLVTVSSAS

SEQ ID NO: 434 - protein, 123 aa, Artificial Sequence
  Description of Artificial Sequence: Synthetic polypeptide
  VH5-51_IGHD5-18*01>3_IGHJ4*01 G100K/G104T G24A/S28R/G35V
EVQLVQSGAEVKKPGESLKISCKASGYRFTSYWIVWVRQMPGKGLEWMGIIYPGDSDTRYSPSFQGQVTISADKSISTAYLQWSSLKASDTAMYYCARRKYSYTYDYFDYWGQGTLVTVSSAS

SEQ ID NO: 435 - protein, 123 aa, Artificial Sequence
  Description of Artificial Sequence: Synthetic polypeptide
  VH5-51_IGHD5-18*01>3_IGHJ4*01 G100K/G104T G24T/S28R/G35V Y105H
EVQLVQSGAEVKKPGESLKISCKTSGYRFTSYWIVWVRQMPGKGLEWMGIIYPGDSDTRYSPSFQGQVTISADKSISTAYLQWSSLKASDTAMYYCARRKYSYTHDYFDYWGQGTLVTVSSAS

SEQ ID NO: 436 - protein, 123 aa, Artificial Sequence
  Description of Artificial Sequence: Synthetic polypeptide
  VH5-51_IGHD5-18*01>3_IGHJ4*01 G100K/G104T G24T/S28R/G35V Y105N
EVQLVQSGAEVKKPGESLKISCKTSGYRFTSYWIVWVRQMPGKGLEWMGIIYPGDSDTRYSPSFQGQVTISADKSISTAYLQWSSLKASDTAMYYCARRKYSYTNDYFDYWGQGTLVTVSSAS

SEQ ID NO: 437 - protein, 123 aa, Artificial Sequence
  Description of Artificial Sequence: Synthetic polypeptide
  VH5-51_IGHD5-18*01>3_IGHJ4*01 G100K/G104T G24T/S28R/G35V Y107F
EVQLVQSGAEVKKPGESLKISCKTSGYRFTSYWIVWVRQMPGKGLEWMGIIYPGDSDTRYSPSFQGQVTISADKSISTAYLQWSSLKASDTAMYYCARRKYSYTYDFFDYWGQGTLVTVSSAS

SEQ ID NO: 438 - protein, 123 aa, Artificial Sequence
  Description of Artificial Sequence: Synthetic polypeptide
  VH5-51_IGHD5-18*01>3_IGHJ4*01 G100K/G104T G24T/S28R/G35V D109Q
EVQLVQSGAEVKKPGESLKISCKTSGYRFTSYWIVWVRQMPGKGLEWMGIIYPGDSDTRYSPSFQGQVTISADKSISTAYLQWSSLKASDTAMYYCARRKYSYTYDYFQYWGQGTLVTVSSAS

SEQ ID NO: 439 - protein, 111 aa, Artificial Sequence
  Description of Artificial Sequence: Synthetic polypeptide
  V3-4_IGLJ1*01 V91A
QTVVTQEPSFSVSPGGTVTLTCGLSSGSVSTSYYPSWYQQTPGQAPRTLIYSTNTRSSGVPDRFSGSILGNKAALTITGAQADDESDYYCALYMGSGISYVFGTGTKVTVL

SEQ ID NO: 440 - protein, 111 aa, Artificial Sequence
  Description of Artificial Sequence: Synthetic polypeptide
  V3-4_IGLJ1*01 L92A
QTVVTQEPSFSVSPGGTVTLTCGLSSGSVSTSYYPSWYQQTPGQAPRTLIYSTNTRSSGVPDRFSGSILGNKAALTITGAQADDESDYYCVAYMGSGISYVFGTGTKVTVL

SEQ ID NO: 441 - protein, 111 aa, Artificial Sequence
  Description of Artificial Sequence: Synthetic polypeptide
  V3-4_IGLJ1*01 Y93A
QTVVTQEPSFSVSPGGTVTLTCGLSSGSVSTSYYPSWYQQTPGQAPRTLIYSTNTRSSGVPDRFSGSILGNKAALTITGAQADDESDYYCVLAMGSGISYVFGTGTKVTVL

SEQ ID NO: 442 - protein, 111 aa, Artificial Sequence
  Description of Artificial Sequence: Synthetic polypeptide
  V3-4_IGLJ1*01 M94A
QTVVTQEPSFSVSPGGTVTLTCGLSSGSVSTSYYPSWYQQTPGQAPRTLIYSTNTRSSGVPDRFSGSILGNKAALTITGAQADDESDYYCVLYAGSGISYVFGTGTKVTVL

SEQ ID NO: 443 - protein, 111 aa, Artificial Sequence
  Description of Artificial Sequence: Synthetic polypeptide
  V3-4_IGLJ1*01 G95A
QTVVTQEPSFSVSPGGTVTLTCGLSSGSVSTSYYPSWYQQTPGQAPRTLIYSTNTRSSGVPDRFSGSILGNKAALTITGAQADDESDYYCVLYMASGISYVFGTGTKVTVL

SEQ ID NO: 444 - protein, 111 aa, Artificial Sequence
  Description of Artificial Sequence: Synthetic polypeptide
  V3-4_IGLJ1*01 G97A
QTVVTQEPSFSVSPGGTVTLTCGLSSGSVSTSYYPSWYQQTPGQAPRTLIYSTNTRSSGVPDRFSGSILGNKAALTITGAQADDESDYYCVLYMGSAISYVFGTGTKVTVL

SEQ ID NO: 445 - protein, 111 aa, Artificial Sequence
  Description of Artificial Sequence: Synthetic polypeptide
  V3-4_IGLJ1*01 S96A
QTVVTQEPSFSVSPGGTVTLTCGLSSGSVSTSYYPSWYQQTPGQAPRTLIYSTNTRSSGVPDRFSGSILGNKAALTITGAQADDESDYYCVLYMGAGISYVFGTGTKVTVL

SEQ ID NO: 446 - protein, 111 aa, Artificial Sequence
  Description of Artificial Sequence: Synthetic polypeptide
  V3-4_IGLJ1*01 I98A
QTVVTQEPSFSVSPGGTVTLTCGLSSGSVSTSYYPSWYQQTPGQAPRTLIYSTNTRSSGVPDRFSGSILGNKAALTITGAQADDESDYYCVLYMGSGASYVFGTGTKVTVL

SEQ ID NO: 447 - protein, 111 aa, Artificial Sequence
  Description of Artificial Sequence: Synthetic polypeptide
  V3-4_IGLJ1*01 S99A
QTVVTQEPSFSVSPGGTVTLTCGLSSGSVSTSYYPSWYQQTPGQAPRTLIYSTNTRSSGVPDRFSGSILGNKAALTITGAQADDESDYYCVLYMGSGIAYVFGTGTKVTVL

SEQ ID NO: 448 - protein, 111 aa, Artificial Sequence
  Description of Artificial Sequence: Synthetic polypeptide
  V3-4_IGLJ1*01 V91P
QTVVTQEPSFSVSPGGTVTLTCGLSSGSVSTSYYPSWYQQTPGQAPRTLIYSTNTRSSGVPDRFSGSILGNKAALTITGAQADDESDYYCPLYMGSGISYVFGTGTKVTVL

SEQ ID NO: 449 - protein, 111 aa, Artificial Sequence
  Description of Artificial Sequence: Synthetic polypeptide
  V3-4_IGLJ1*01 V91T
QTVVTQEPSFSVSPGGTVTLTCGLSSGSVSTSYYPSWYQQTPGQAPRTLIYSTNTRSSGVPDRFSGSILGNKAALTITGAQADDESDYYCTLYMGSGISYVFGTGTKVTVL

SEQ ID NO: 450 - protein, 111 aa, Artificial Sequence
  Description of Artificial Sequence: Synthetic polypeptide
  V3-4_IGLJ1*01 V91S
QTVVTQEPSFSVSPGGTVTLTCGLSSGSVSTSYYPSWYQQTPGQAPRTLIYSTNTRSSGVPDRFSGSILGNKAALTITGAQADDESDYYCSLYMGSGISYVFGTGTKVTVL

SEQ ID NO: 451 - protein, 111 aa, Artificial Sequence
  Description of Artificial Sequence: Synthetic polypeptide
  V3-4_IGLJ1*01 V91L
QTVVTQEPSFSVSPGGTVTLTCGLSSGSVSTSYYPSWYQQTPGQAPRTLIYSTNTRSSGVPDRFSGSILGNKAALTITGAQADDESDYYCLLYMGSGISYVFGTGTKVTVL

SEQ ID NO: 452 - protein, 111 aa, Artificial Sequence
  Description of Artificial Sequence: Synthetic polypeptide
  V3-4_IGLJ1*01 V91R
QTVVTQEPSFSVSPGGTVTLTCGLSSGSVSTSYYPSWYQQTPGQAPRTLIYSTNTRSSGVPDRFSGSILGNKAALTITGAQADDESDYYCRLYMGSGISYVFGTGTKVTVL

SEQ ID NO: 453 - protein, 111 aa, Artificial Sequence
  Description of Artificial Sequence: Synthetic polypeptide
  V3-4_IGLJ1*01 V91C
QTVVTQEPSFSVSPGGTVTLTCGLSSGSVSTSYYPSWYQQTPGQAPRTLIYSTNTRSSGVPDRFSGSILGNKAALTITGAQADDESDYYCCLYMGSGISYVFGTGTKVTVL

SEQ ID NO: 454 - protein, 111 aa, Artificial Sequence
  Description of Artificial Sequence: Synthetic polypeptide
  V3-4_IGLJ1*01 V91E
QTVVTQEPSFSVSPGGTVTLTCGLSSGSVSTSYYPSWYQQTPGQAPRTLIYSTNTRSSGVPDRFSGSILGNKAALTITGAQADDESDYYCELYMGSGISYVFGTGTKVTVL

SEQ ID NO: 455 - protein, 111 aa, Artificial Sequence
  Description of Artificial Sequence: Synthetic polypeptide
  V3-4_IGLJ1*01 V91W
QTVVTQEPSFSVSPGGTVTLTCGLSSGSVSTSYYPSWYQQTPGQAPRTLIYSTNTRSSGVPDRFSGSILGNKAALTITGAQADDESDYYCWLYMGSGISYVFGTGTKVTVL

SEQ ID NO: 456 - protein, 111 aa, Artificial Sequence
  Description of Artificial Sequence: Synthetic polypeptide
  V3-4_IGLJ1*01 V91N
QTVVTQEPSFSVSPGGTVTLTCGLSSGSVSTSYYPSWYQQTPGQAPRTLIYSTNTRSSGVPDRFSGSILGNKAALTITGAQADDESDYYCNLYMGSGISYVFGTGTKVTVL

SEQ ID NO: 457 - protein, 111 aa, Artificial Sequence
  Description of Artificial Sequence: Synthetic polypeptide
  V3-4_IGLJ1*01 V91I
QTVVTQEPSFSVSPGGTVTLTCGLSSGSVSTSYYPSWYQQTPGQAPRTLIYSTNTRSSGVPDRFSGSILGNKAALTITGAQADDESDYYCILYMGSGISYVFGTGTKVTVL

SEQ ID NO: 458 - protein, 111 aa, Artificial Sequence
  Description of Artificial Sequence: Synthetic polypeptide
  V3-4_IGLJ1*01 V91G
QTVVTQEPSFSVSPGGTVTLTCGLSSGSVSTSYYPSWYQQTPGQAPRTLIYSTNTRSSGVPDRFSGSILGNKAALTITGAQADDESDYYCGLYMGSGISYVFGTGTKVTVL

SEQ ID NO: 459 - protein, 111 aa, Artificial Sequence
  Description of Artificial Sequence: Synthetic polypeptide
  V3-4_IGLJ1*01 V91H
QTVVTQEPSFSVSPGGTVTLTCGLSSGSVSTSYYPSWYQQTPGQAPRTLIYSTNTRSSGVPDRFSGSILGNKAALTITGAQADDESDYYCHLYMGSGISYVFGTGTKVTVL

SEQ ID NO: 460 - protein, 111 aa, Artificial Sequence
  Description of Artificial Sequence: Synthetic polypeptide
  V3-4_IGLJ1*01 M94E
QTVVTQEPSFSVSPGGTVTLTCGLSSGSVSTSYYPSWYQQTPGQAPRTLIYSTNTRSSGVPDRFSGSILGNKAALTITGAQADDESDYYCVLYEGSGISYVFGTGTKVTVL

SEQ ID NO: 461 - protein, 111 aa, Artificial Sequence
  Description of Artificial Sequence: Synthetic polypeptide
  V3-4_IGLJ1*01 M94S
QTVVTQEPSFSVSPGGTVTLTCGLSSGSVSTSYYPSWYQQTPGQAPRTLIYSTNTRSSGVPDRFSGSILGNKAALTITGAQADDESDYYCVLYSGSGISYVFGTGTKVTVL

SEQ ID NO: 462 - protein, 111 aa, Artificial Sequence
  Description of Artificial Sequence: Synthetic polypeptide
  V3-4_IGLJ1*01 M94G
QTVVTQEPSFSVSPGGTVTLTCGLSSGSVSTSYYPSWYQQTPGQAPRTLIYSTNTRSSGVPDRFSGSILGNKAALTITGAQADDESDYYCVLYGGSGISYVFGTGTKVTVL

SEQ ID NO: 463 - protein, 111 aa, Artificial Sequence
  Description of Artificial Sequence: Synthetic polypeptide
  V3-4_IGLJ1*01 M94L
QTVVTQEPSFSVSPGGTVTLTCGLSSGSVSTSYYPSWYQQTPGQAPRTLIYSTNTRSSGVPDRFSGSILGNKAALTITGAQADDESDYYCVLYLGSGISYVFGTGTKVTVL

SEQ ID NO: 464 - protein, 111 aa, Artificial Sequence
  Description of Artificial Sequence: Synthetic polypeptide
  V3-4_IGLJ1*01 M94P
QTVVTQEPSFSVSPGGTVTLTCGLSSGSVSTSYYPSWYQQTPGQAPRTLIYSTNTRSSGVPDRFSGSILGNKAALTITGAQADDESDYYCVLYPGSGISYVFGTGTKVTVL

SEQ ID NO: 465 - protein, 111 aa, Artificial Sequence
  Description of Artificial Sequence: Synthetic polypeptide
  V3-4_IGLJ1*01 M94V
QTVVTQEPSFSVSPGGTVTLTCGLSSGSVSTSYYPSWYQQTPGQAPRTLIYSTNTRSSGVPDRFSGSILGNKAALTITGAQADDESDYYCVLYVGSGISYVFGTGTKVTVL

SEQ ID NO: 466 - protein, 111 aa, Artificial Sequence
  Description of Artificial Sequence: Synthetic polypeptide
  V3-4_IGLJ1*01 M94D
QTVVTQEPSFSVSPGGTVTLTCGLSSGSVSTSYYPSWYQQTPGQAPRTLIYSTNTRSSGVPDRFSGSILGNKAALTITGAQADDESDYYCVLYDGSGISYVFGTGTKVTVL

SEQ ID NO: 467 - protein, 111 aa, Artificial Sequence
  Description of Artificial Sequence: Synthetic polypeptide
  V3-4_IGLJ1*01 M94R
QTVVTQEPSFSVSPGGTVTLTCGLSSGSVSTSYYPSWYQQTPGQAPRTLIYSTNTRSSGVPDRFSGSILGNKAALTITGAQADDESDYYCVLYRGSGISYVFGTGTKVTVL

SEQ ID NO: 468 - protein, 111 aa, Artificial Sequence
  Description of Artificial Sequence: Synthetic polypeptide
  V3-4_IGLJ1*01 M94N
QTVVTQEPSFSVSPGGTVTLTCGLSSGSVSTSYYPSWYQQTPGQAPRTLIYSTNTRSSGVPDRFSGSILGNKAALTITGAQADDESDYYCVLYNGSGISYVFGTGTKVTVL

SEQ ID NO: 469 - protein, 111 aa, Artificial Sequence
  Description of Artificial Sequence: Synthetic polypeptide
  V3-4_IGLJ1*01 M94T
QTVVTQEPSFSVSPGGTVTLTCGLSSGSVSTSYYPSWYQQTPGQAPRTLIYSTNTRSSGVPDRFSGSILGNKAALTITGAQADDESDYYCVLYTGSGISYVFGTGTKVTVL

SEQ ID NO: 470 - protein, 111 aa, Artificial Sequence
  Description of Artificial Sequence: Synthetic polypeptide
  V3-4_IGLJ1*01 M94F
QTVVTQEPSFSVSPGGTVTLTCGLSSGSVSTSYYPSWYQQTPGQAPRTLIYSTNTRSSGVPDRFSGSILGNKAALTITGAQADDESDYYCVLYFGSGISYVFGTGTKVTVL

SEQ ID NO: 471 - protein, 111 aa, Artificial Sequence
  Description of Artificial Sequence: Synthetic polypeptide
  V3-4_IGLJ1*01 S96W
QTVVTQEPSFSVSPGGTVTLTCGLSSGSVSTSYYPSWYQQTPGQAPRTLIYSTNTRSSGVPDRFSGSILGNKAALTITGAQADDESDYYCVLYMGWGISYVFGTGTKVTVL

SEQ ID NO: 472 - protein, 111 aa, Artificial Sequence
  Description of Artificial Sequence: Synthetic polypeptide
  V3-4_IGLJ1*01 S96G
QTVVTQEPSFSVSPGGTVTLTCGLSSGSVSTSYYPSWYQQTPGQAPRTLIYSTNTRSSGVPDRFSGSILGNKAALTITGAQADDESDYYCVLYMGGGISYVFGTGTKVTVL

SEQ ID NO: 473 - protein, 111 aa, Artificial Sequence
  Description of Artificial Sequence: Synthetic polypeptide
  V3-4_IGLJ1*01 S96P
QTVVTQEPSFSVSPGGTVTLTCGLSSGSVSTSYYPSWYQQTPGQAPRTLIYSTNTRSSGVPDRFSGSILGNKAALTITGAQADDESDYYCVLYMGPGISYVFGTGTKVTVL

SEQ ID NO: 474 - protein, 111 aa, Artificial Sequence
  Description of Artificial Sequence: Synthetic polypeptide
  V3-4_IGLJ1*01 S96R
QTVVTQEPSFSVSPGGTVTLTCGLSSGSVSTSYYPSWYQQTPGQAPRTLIYSTNTRSSGVPDRFSGSILGNKAALTITGAQADDESDYYCVLYMGRGISYVFGTGTKVTVL

SEQ ID NO: 475 - protein, 111 aa, Artificial Sequence
  Description of Artificial Sequence: Synthetic polypeptide
  V3-4_IGLJ1*01 S96L
QTVVTQEPSFSVSPGGTVTLTCGLSSGSVSTSYYPSWYQQTPGQAPRTLIYSTNTRSSGVPDRFSGSILGNKAALTITGAQADDESDYYCVLYMGLGISYVFGTGTKVTVL

SEQ ID NO: 476 - protein, 111 aa, Artificial Sequence
  Description of Artificial Sequence: Synthetic polypeptide
  V3-4_IGLJ1*01 S96M
QTVVTQEPSFSVSPGGTVTLTCGLSSGSVSTSYYPSWYQQTPGQAPRTLIYSTNTRSSGVPDRFSGSILGNKAALTITGAQADDESDYYCVLYMGMGISYVFGTGTKVTVL

SEQ ID NO: 477 - protein, 111 aa, Artificial Sequence
  Description of Artificial Sequence: Synthetic polypeptide
  V3-4_IGLJ1*01 S96E
QTVVTQEPSFSVSPGGTVTLTCGLSSGSVSTSYYPSWYQQTPGQAPRTLIYSTNTRSSGVPDRFSGSILGNKAALTITGAQADDESDYYCVLYMGEGISYVFGTGTKVTVL

SEQ ID NO: 478 - protein, 111 aa, Artificial Sequence
  Description of Artificial Sequence: Synthetic polypeptide
  V3-4_IGLJ1*01 S96V
QTVVTQEPSFSVSPGGTVTLTCGLSSGSVSTSYYPSWYQQTPGQAPRTLIYSTNTRSSGVPDRFSGSILGNKAALTITGAQADDESDYYCVLYMGVGISYVFGTGTKVTVL

SEQ ID NO: 479 - protein, 111 aa, Artificial Sequence
  Description of Artificial Sequence: Synthetic polypeptide
  V3-4_IGLJ1*01 M94R/S96M
QTVVTQEPSFSVSPGGTVTLTCGLSSGSVSTSYYPSWYQQTPGQAPRTLIYSTNTRSSGVPDRFSGSILGNKAALTITGAQADDESDYYCVLYRGMGISYVFGTGTKVTVL

SEQ ID NO: 480 - protein, 111 aa, Artificial Sequence
  Description of Artificial Sequence: Synthetic polypeptide
  V3-4_IGLJ1*01 L24A
QTVVTQEPSFSVSPGGTVTLTCGASSGSVSTSYYPSWYQQTPGQAPRTLIYSTNTRSSGVPDRFSGSILGNKAALTITGAQADDESDYYCVLYMGSGISYVFGTGTKVTVL

SEQ ID NO: 481 - protein, 111 aa, Artificial Sequence
  Description of Artificial Sequence: Synthetic polypeptide
  V3-4_IGLJ1*01 S26A
QTVVTQEPSFSVSPGGTVTLTCGLSAGSVSTSYYPSWYQQTPGQAPRTLIYSTNTRSSGVPDRFSGSILGNKAALTITGAQADDESDYYCVLYMGSGISYVFGTGTKVTVL

SEQ ID NO: 482 - protein, 111 aa, Artificial Sequence
  Description of Artificial Sequence: Synthetic polypeptide
  V3-4_IGLJ1*01 G27A
QTVVTQEPSFSVSPGGTVTLTCGLSSASVSTSYYPSWYQQTPGQAPRTLIYSTNTRSSGVPDRFSGSILGNKAALTITGAQADDESDYYCVLYMGSGISYVFGTGTKVTVL

SEQ ID NO: 483 - protein, 111 aa, Artificial Sequence
  Description of Artificial Sequence: Synthetic polypeptide
  V3-4_IGLJ1*01 S28A
QTVVTQEPSFSVSPGGTVTLTCGLSSGAVSTSYYPSWYQQTPGQAPRTLIYSTNTRSSGVPDRFSGSILGNKAALTITGAQADDESDYYCVLYMGSGISYVFGTGTKVTVL

SEQ ID NO: 484 - protein, 111 aa, Artificial Sequence
  Description of Artificial Sequence: Synthetic polypeptide
  V3-4_IGLJ1*01 V29A
QTVVTQEPSFSVSPGGTVTLTCGLSSGSASTSYYPSWYQQTPGQAPRTLIYSTNTRSSGVPDRFSGSILGNKAALTITGAQADDESDYYCVLYMGSGISYVFGTGTKVTVL

SEQ ID NO: 485 - protein, 111 aa, Artificial Sequence
  Description of Artificial Sequence: Synthetic polypeptide
  V3-4_IGLJ1*01 S30A
QTVVTQEPSFSVSPGGTVTLTCGLSSGSVATSYYPSWYQQTPGQAPRTLIYSTNTRSSGVPDRFSGSILGNKAALTITGAQADDESDYYCVLYMGSGISYVFGTGTKVTVL

SEQ ID NO: 486 - protein, 111 aa, Artificial Sequence
  Description of Artificial Sequence: Synthetic polypeptide
  V3-4_IGLJ1*01 T31A
QTVVTQEPSFSVSPGGTVTLTCGLSSGSVSASYYPSWYQQTPGQAPRTLIYSTNTRSSGVPDRFSGSILGNKAALTITGAQADDESDYYCVLYMGSGISYVFGTGTKVTVL

SEQ ID NO: 487 - protein, 111 aa, Artificial Sequence
  Description of Artificial Sequence: Synthetic polypeptide
  V3-4_IGLJ1*01 S32A
QTVVTQEPSFSVSPGGTVTLTCGLSSGSVSTAYYPSWYQQTPGQAPRTLIYSTNTRSSGVPDRFSGSILGNKAALTITGAQADDESDYYCVLYMGSGISYVFGTGTKVTVL

SEQ ID NO: 488 - protein, 111 aa, Artificial Sequence
  Description of Artificial Sequence: Synthetic polypeptide
  V3-4_IGLJ1*01 Y33A
QTVVTQEPSFSVSPGGTVTLTCGLSSGSVSTSAYPSWYQQTPGQAPRTLIYSTNTRSSGVPDRFSGSILGNKAALTITGAQADDESDYYCVLYMGSGISYVFGTGTKVTVL

SEQ ID NO: 489 - protein, 111 aa, Artificial Sequence
  Description of Artificial Sequence: Synthetic polypeptide
  V3-4_IGLJ1*01 Y34A
QTVVTQEPSFSVSPGGTVTLTCGLSSGSVSTSYAPSWYQQTPGQAPRTLIYSTNTRSSGVPDRFSGSILGNKAALTITGAQADDESDYYCVLYMGSGISYVFGTGTKVTVL

SEQ ID NO: 490 - protein, 111 aa, Artificial Sequence
  Description of Artificial Sequence: Synthetic polypeptide
  V3-4_IGLJ1*01 P35A
QTVVTQEPSFSVSPGGTVTLTCGLSSGSVSTSYYASWYQQTPGQAPRTLIYSTNTRSSGVPDRFSGSILGNKAALTITGAQADDESDYYCVLYMGSGISYVFGTGTKVTVL

SEQ ID NO: 491 - protein, 111 aa, Artificial Sequence
  Description of Artificial Sequence: Synthetic polypeptide
  V3-4_IGLJ1*01 S36A
QTVVTQEPSFSVSPGGTVTLTCGLSSGSVSTSYYPAWYQQTPGQAPRTLIYSTNTRSSGVPDRFSGSILGNKAALTITGAQADDESDYYCVLYMGSGISYVFGTGTKVTVL

SEQ ID NO: 492 - protein, 111 aa, Artificial Sequence
  Description of Artificial Sequence: Synthetic polypeptide
  V3-4_IGLJ1*01 G23A
QTVVTQEPSFSVSPGGTVTLTCALSSGSVSTSYYPSWYQQTPGQAPRTLIYSTNTRSSGVPDRFSGSILGNKAALTITGAQADDESDYYCVLYMGSGISYVFGTGTKVTVL

SEQ ID NO: 493 - protein, 111 aa, Artificial Sequence
  Description of Artificial Sequence: Synthetic polypeptide
  V3-4_IGLJ1*01 S25A
QTVVTQEPSFSVSPGGTVTLTCGLASGSVSTSYYPSWYQQTPGQAPRTLIYSTNTRSSGVPDRFSGSILGNKAALTITGAQADDESDYYCVLYMGSGISYVFGTGTKVTVL

SEQ ID NO: 494 - protein, 111 aa, Artificial Sequence
  Description of Artificial Sequence: Synthetic polypeptide
  V3-4_IGLJ1*01 G23R
QTVVTQEPSFSVSPGGTVTLTCRLSSGSVSTSYYPSWYQQTPGQAPRTLIYSTNTRSSGVPDRFSGSILGNKAALTITGAQADDESDYYCVLYMGSGISYVFGTGTKVTVL

SEQ ID NO: 495 - protein, 111 aa, Artificial Sequence
  Description of Artificial Sequence: Synthetic polypeptide
  V3-4_IGLJ1*01 G23L
QTVVTQEPSFSVSPGGTVTLTCLLSSGSVSTSYYPSWYQQTPGQAPRTLIYSTNTRSSGVPDRFSGSILGNKAALTITGAQADDESDYYCVLYMGSGISYVFGTGTKVTVL

SEQ ID NO: 496 - protein, 111 aa, Artificial Sequence
  Description of Artificial Sequence: Synthetic polypeptide
  V3-4_IGLJ1*01 S52A
QTVVTQEPSFSVSPGGTVTLTCGLSSGSVSTSYYPSWYQQTPGQAPRTLIYATNTRSSGVPDRFSGSILGNKAALTITGAQADDESDYYCVLYMGSGISYVFGTGTKVTVL

SEQ ID NO: 497 - protein, 111 aa, Artificial Sequence
  Description of Artificial Sequence: Synthetic polypeptide
  V3-4_IGLJ1*01 T53A
QTVVTQEPSFSVSPGGTVTLTCGLSSGSVSTSYYPSWYQQTPGQAPRTLIYSANTRSSGVPDRFSGSILGNKAALTITGAQADDESDYYCVLYMGSGISYVFGTGTKVTVL

SEQ ID NO: 498 - protein, 111 aa, Artificial Sequence
  Description of Artificial Sequence: Synthetic polypeptide
  V3-4_IGLJ1*01 N54A
QTVVTQEPSFSVSPGGTVTLTCGLSSGSVSTSYYPSWYQQTPGQAPRTLIYSTATRSSGVPDRFSGSILGNKAALTITGAQADDESDYYCVLYMGSGISYVFGTGTKVTVL

SEQ ID NO: 499 - protein, 111 aa, Artificial Sequence
  Description of Artificial Sequence: Synthetic polypeptide
  V3-4_IGLJ1*01 T55A
QTVVTQEPSFSVSPGGTVTLTCGLSSGSVSTSYYPSWYQQTPGQAPRTLIYSTNARSSGVPDRFSGSILGNKAALTITGAQADDESDYYCVLYMGSGISYVFGTGTKVTVL

SEQ ID NO: 500 - protein, 111 aa, Artificial Sequence
  Description of Artificial Sequence: Synthetic polypeptide
  V3-4_IGLJ1*01 R56A
QTVVTQEPSFSVSPGGTVTLTCGLSSGSVSTSYYPSWYQQTPGQAPRTLIYSTNTASSGVPDRFSGSILGNKAALTITGAQADDESDYYCVLYMGSGISYVFGTGTKVTVL

SEQ ID NO: 501 - protein, 111 aa, Artificial Sequence
  Description of Artificial Sequence: Synthetic polypeptide
  V3-4_IGLJ1*01 S57A
QTVVTQEPSFSVSPGGTVTLTCGLSSGSVSTSYYPSWYQQTPGQAPRTLIYSTNTRASGVPDRFSGSILGNKAALTITGAQADDESDYYCVLYMGSGISYVFGTGTKVTVL

SEQ ID NO: 502 - protein, 111 aa, Artificial Sequence
  Description of Artificial Sequence: Synthetic polypeptide
  V3-4_IGLJ1*01 S58A
QTVVTQEPSFSVSPGGTVTLTCGLSSGSVSTSYYPSWYQQTPGQAPRTLIYSTNTRSAGVPDRFSGSILGNKAALTITGAQADDESDYYCVLYMGSGISYVFGTGTKVTVL

SEQ ID NO: 503 - protein, 111 aa, Artificial Sequence
  Description of Artificial Sequence: Synthetic polypeptide
  V3-4_IGLJ1*01 S52G
QTVVTQEPSFSVSPGGTVTLTCGLSSGSVSTSYYPSWYQQTPGQAPRTLIYGTNTRSSGVPDRFSGSILGNKAALTITGAQADDESDYYCVLYMGSGISYVFGTGTKVTVL

SEQ ID NO: 504 - protein, 111 aa, Artificial Sequence
  Description of Artificial Sequence: Synthetic polypeptide
  V3-4_IGLJ1*01 S52C
QTVVTQEPSFSVSPGGTVTLTCGLSSGSVSTSYYPSWYQQTPGQAPRTLIYCTNTRSSGVPDRFSGSILGNKAALTITGAQADDESDYYCVLYMGSGISYVFGTGTKVTVL

SEQ ID NO: 505 - protein, 111 aa, Artificial Sequence
  Description of Artificial Sequence: Synthetic polypeptide
  V3-4_IGLJ1*01 S52R
QTVVTQEPSFSVSPGGTVTLTCGLSSGSVSTSYYPSWYQQTPGQAPRTLIYRTNTRSSGVPDRFSGSILGNKAALTITGAQADDESDYYCVLYMGSGISYVFGTGTKVTVL

SEQ ID NO: 506 - protein, 111 aa, Artificial Sequence
  Description of Artificial Sequence: Synthetic polypeptide
  V3-4_IGLJ1*01 R56I
QTVVTQEPSFSVSPGGTVTLTCGLSSGSVSTSYYPSWYQQTPGQAPRTLIYSTNTISSGVPDRFSGSILGNKAALTITGAQADDESDYYCVLYMGSGISYVFGTGTKVTVL

SEQ ID NO: 507 - protein, 111 aa, Artificial Sequence
  Description of Artificial Sequence: Synthetic polypeptide
  V3-4_IGLJ1*01 R56Y
QTVVTQEPSFSVSPGGTVTLTCGLSSGSVSTSYYPSWYQQTPGQAPRTLIYSTNTYSSGVPDRFSGSILGNKAALTITGAQADDESDYYCVLYMGSGISYVFGTGTKVTVL

SEQ ID NO: 508 - protein, 111 aa, Artificial Sequence
  Description of Artificial Sequence: Synthetic polypeptide
  V3-4_IGLJ1*01 R56D
QTVVTQEPSFSVSPGGTVTLTCGLSSGSVSTSYYPSWYQQTPGQAPRTLIYSTNTDSSGVPDRFSGSILGNKAALTITGAQADDESDYYCVLYMGSGISYVFGTGTKVTVL

SEQ ID NO: 509 - protein, 111 aa, Artificial Sequence
  Description of Artificial Sequence: Synthetic polypeptide
  V3-4_IGLJ1*01 R56G
QTVVTQEPSFSVSPGGTVTLTCGLSSGSVSTSYYPSWYQQTPGQAPRTLIYSTNTGSSGVPDRFSGSILGNKAALTITGAQADDESDYYCVLYMGSGISYVFGTGTKVTVL

SEQ ID NO: 510 - protein, 111 aa, Artificial Sequence
  Description of Artificial Sequence: Synthetic polypeptide
  V3-4_IGLJ1*01 R56S
QTVVTQEPSFSVSPGGTVTLTCGLSSGSVSTSYYPSWYQQTPGQAPRTLIYSTNTSSSGVPDRFSGSILGNKAALTITGAQADDESDYYCVLYMGSGISYVFGTGTKVTVL

SEQ ID NO: 511 - protein, 111 aa, Artificial Sequence
  Description of Artificial Sequence: Synthetic polypeptide
  V3-4_IGLJ1*01 T78S
QTVVTQEPSFSVSPGGTVTLTCGLSSGSVSTSYYPSWYQQTPGQAPRTLIYSTNTRSSGVPDRFSGSILGNKAALTISGAQADDESDYYCVLYMGSGISYVFGTGTKVTVL

SEQ ID NO: 512 - protein, 111 aa, Artificial Sequence
  Description of Artificial Sequence: Synthetic polypeptide
  V3-4_IGLJ1*01 T78E
QTVVTQEPSFSVSPGGTVTLTCGLSSGSVSTSYYPSWYQQTPGQAPRTLIYSTNTRSSGVPDRFSGSILGNKAALTIEGAQADDESDYYCVLYMGSGISYVFGTGTKVTVL

SEQ ID NO: 513 - protein, 111 aa, Artificial Sequence
  Description of Artificial Sequence: Synthetic polypeptide
  V3-4_IGLJ1*01 T78Y
QTVVTQEPSFSVSPGGTVTLTCGLSSGSVSTSYYPSWYQQTPGQAPRTLIYSTNTRSSGVPDRFSGSILGNKAALTIYGAQADDESDYYCVLYMGSGISYVFGTGTKVTVL

SEQ ID NO: 514 - protein, 111 aa, Artificial Sequence
  Description of Artificial Sequence: Synthetic polypeptide
  V3-4_IGLJ1*01 T78M
QTVVTQEPSFSVSPGGTVTLTCGLSSGSVSTSYYPSWYQQTPGQAPRTLIYSTNTRSSGVPDRFSGSILGNKAALTIMGAQADDESDYYCVLYMGSGISYVFGTGTKVTVL

SEQ ID NO: 515 - protein, 111 aa, Artificial Sequence
  Description of Artificial Sequence: Synthetic polypeptide
  V3-4_IGLJ1*01 T78L
QTVVTQEPSFSVSPGGTVTLTCGLSSGSVSTSYYPSWYQQTPGQAPRTLIYSTNTRSSGVPDRFSGSILGNKAALTILGAQADDESDYYCVLYMGSGISYVFGTGTKVTVL

SEQ ID NO: 516 - protein, 111 aa, Artificial Sequence
  Description of Artificial Sequence: Synthetic polypeptide
  V3-4_IGLJ1*01 T78K
QTVVTQEPSFSVSPGGTVTLTCGLSSGSVSTSYYPSWYQQTPGQAPRTLIYSTNTRSSGVPDRFSGSILGNKAALTIKGAQADDESDYYCVLYMGSGISYVFGTGTKVTVL

SEQ ID NO: 517 - protein, 111 aa, Artificial Sequence
  Description of Artificial Sequence: Synthetic polypeptide
  V3-4_IGLJ1*01 T78V
QTVVTQEPSFSVSPGGTVTLTCGLSSGSVSTSYYPSWYQQTPGQAPRTLIYSTNTRSSGVPDRFSGSILGNKAALTIVGAQADDESDYYCVLYMGSGISYVFGTGTKVTVL

SEQ ID NO: 518 - protein, 217 aa, Artificial Sequence
  Description of Artificial Sequence: Synthetic polypeptide
  V3-4_IGLJ1*01 G23A/N175K
QTVVTQEPSFSVSPGGTVTLTCALSSGSVSTSYYPSWYQQTPGQAPRTLIYSTNTRSSGVPDRFSGSILGNKAALTITGAQADDESDYYCVLYMGSGISYVFGTGTKVTVLGQPKAAPSVTLFPPSSEELQANKATLVCLISDFYPGAVTVAWKADSSPVKAGVETTTPSKQSNKKYAASSYLSLTPEQWKSHRSYSCQVTHEGSTVEKTVAPTECS

SEQ ID NO: 519 - protein, 217 aa, Artificial Sequence
  Description of Artificial Sequence: Synthetic polypeptide
  V3-4_IGLJ1*01 S25A/A116T
QTVVTQEPSFSVSPGGTVTLTCGLASGSVSTSYYPSWYQQTPGQAPRTLIYSTNTRSSGVPDRFSGSILGNKAALTITGAQADDESDYYCVLYMGSGISYVFGTGTKVTVLGQPKTAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 520 - protein, 111 aa, Artificial Sequence
  Description of Artificial Sequence: Synthetic polypeptide
  V3-4_IGLJ1*01 V91L/S96P S52F
QTVVTQEPSFSVSPGGTVTLTCGLSSGSVSTSYYPSWYQQTPGQAPRTLIYFTNTRSSGVPDRFSGSILGNKAALTITGAQADDESDYYCLLYMGPGISYVFGTGTKVTVL

SEQ ID NO: 521 - protein, 111 aa, Artificial Sequence
  Description of Artificial Sequence: Synthetic polypeptide
  V3-4_IGLJ1*01 V91L/S96P S52L
QTVVTQEPSFSVSPGGTVTLTCGLSSGSVSTSYYPSWYQQTPGQAPRTLIYLTNTRSSGVPDRFSGSILGNKAALTITGAQADDESDYYCLLYMGPGISYVFGTGTKVTVL

SEQ ID NO: 522 - protein, 111 aa, Artificial Sequence
  Description of Artificial Sequence: Synthetic polypeptide
  V3-4_IGLJ1*01 V91L/S96P S52I
QTVVTQEPSFSVSPGGTVTLTCGLSSGSVSTSYYPSWYQQTPGQAPRTLIYITNTRSSGVPDRFSGSILGNKAALTITGAQADDESDYYCLLYMGPGISYVFGTGTKVTVL

SEQ ID NO: 523 - protein, 111 aa, Artificial Sequence
  Description of Artificial Sequence: Synthetic polypeptide
  V3-4_IGLJ1*01 V91L/S96P S52M
QTVVTQEPSFSVSPGGTVTLTCGLSSGSVSTSYYPSWYQQTPGQAPRTLIYMTNTRSSGVPDRFSGSILGNKAALTITGAQADDESDYYCLLYMGPGISYVFGTGTKVTVL

SEQ ID NO: 524 - protein, 111 aa, Artificial Sequence
  Description of Artificial Sequence: Synthetic polypeptide
  V3-4_IGLJ1*01 V91L/S96P S52V
QTVVTQEPSFSVSPGGTVTLTCGLSSGSVSTSYYPSWYQQTPGQAPRTLIYVTNTRSSGVPDRFSGSILGNKAALTITGAQADDESDYYCLLYMGPGISYVFGTGTKVTVL

SEQ ID NO: 525 - protein, 111 aa, Artificial Sequence
  Description of Artificial Sequence: Synthetic polypeptide
  V3-4_IGLJ1*01 V91L/S96P S52P
QTVVTQEPSFSVSPGGTVTLTCGLSSGSVSTSYYPSWYQQTPGQAPRTLIYPTNTRSSGVPDRFSGSILGNKAALTITGAQADDESDYYCLLYMGPGISYVFGTGTKVTVL

SEQ ID NO: 526 - protein, 111 aa, Artificial Sequence
  Description of Artificial Sequence: Synthetic polypeptide
  V3-4_IGLJ1*01 V91L/S96P S52T
QTVVTQEPSFSVSPGGTVTLTCGLSSGSVSTSYYPSWYQQTPGQAPRTLIYTTNTRSSGVPDRFSGSILGNKAALTITGAQADDESDYYCLLYMGPGISYVFGTGTKVTVL

SEQ ID NO: 527 - protein, 111 aa, Artificial Sequence
  Description of Artificial Sequence: Synthetic polypeptide
  V3-4_IGLJ1*01 V91L/S96P S52Y
QTVVTQEPSFSVSPGGTVTLTCGLSSGSVSTSYYPSWYQQTPGQAPRTLIYYTNTRSSGVPDRFSGSILGNKAALTITGAQADDESDYYCLLYMGPGISYVFGTGTKVTVL

SEQ ID NO: 528 - protein, 111 aa, Artificial Sequence
  Description of Artificial Sequence: Synthetic polypeptide
  V3-4_IGLJ1*01 V91L/S96P S52H
QTVVTQEPSFSVSPGGTVTLTCGLSSGSVSTSYYPSWYQQTPGQAPRTLIYHTNTRSSGVPDRFSGSILGNKAALTITGAQADDESDYYCLLYMGPGISYVFGTGTKVTVL

SEQ ID NO: 529 - protein, 111 aa, Artificial Sequence
  Description of Artificial Sequence: Synthetic polypeptide
  V3-4_IGLJ1*01 V91L/S96P S52Q
QTVVTQEPSFSVSPGGTVTLTCGLSSGSVSTSYYPSWYQQTPGQAPRTLIYQTNTRSSGVPDRFSGSILGNKAALTITGAQADDESDYYCLLYMGPGISYVFGTGTKVTVL

SEQ ID NO: 530 - protein, 111 aa, Artificial Sequence
  Description of Artificial Sequence: Synthetic polypeptide
  V3-4_IGLJ1*01 V91L/S96P S52N
QTVVTQEPSFSVSPGGTVTLTCGLSSGSVSTSYYPSWYQQTPGQAPRTLIYNTNTRSSGVPDRFSGSILGNKAALTITGAQADDESDYYCLLYMGPGISYVFGTGTKVTVL

SEQ ID NO: 531 - protein, 111 aa, Artificial Sequence
  Description of Artificial Sequence: Synthetic polypeptide
  V3-4_IGLJ1*01 V91L/S96P S52K
QTVVTQEPSFSVSPGGTVTLTCGLSSGSVSTSYYPSWYQQTPGQAPRTLIYKTNTRSSGVPDRFSGSILGNKAALTITGAQADDESDYYCLLYMGPGISYVFGTGTKVTVL

SEQ ID NO: 532 - protein, 111 aa, Artificial Sequence
  Description of Artificial Sequence: Synthetic polypeptide
  V3-4_IGLJ1*01 V91L/S96P S52D
QTVVTQEPSFSVSPGGTVTLTCGLSSGSVSTSYYPSWYQQTPGQAPRTLIYDTNTRSSGVPDRFSGSILGNKAALTITGAQADDESDYYCLLYMGPGISYVFGTGTKVTVL

SEQ ID NO: 533 - protein, 111 aa, Artificial Sequence
  Description of Artificial Sequence: Synthetic polypeptide
  V3-4_IGLJ1*01 V91L/S96P S52E
QTVVTQEPSFSVSPGGTVTLTCGLSSGSVSTSYYPSWYQQTPGQAPRTLIYETNTRSSGVPDRFSGSILGNKAALTITGAQADDESDYYCLLYMGPGISYVFGTGTKVTVL

SEQ ID NO: 534 - protein, 111 aa, Artificial Sequence
  Description of Artificial Sequence: Synthetic polypeptide
  V3-4_IGLJ1*01 V91L/S96P S52W
QTVVTQEPSFSVSPGGTVTLTCGLSSGSVSTSYYPSWYQQTPGQAPRTLIYWTNTRSSGVPDRFSGSILGNKAALTITGAQADDESDYYCLLYMGPGISYVFGTGTKVTVL

SEQ ID NO: 535 - protein, 111 aa, Artificial Sequence
  Description of Artificial Sequence: Synthetic polypeptide
  V3-4_IGLJ1*01 V91L/S96P S52R
QTVVTQEPSFSVSPGGTVTLTCGLSSGSVSTSYYPSWYQQTPGQAPRTLIYRTNTRSSGVPDRFSGSILGNKAALTITGAQADDESDYYCLLYMGPGISYVFGTGTKVTVL

SEQ ID NO: 536 - protein, 111 aa, Artificial Sequence
  Description of Artificial Sequence: Synthetic polypeptide
  V3-4_IGLJ1*01 V91L/S96P S52G
QTVVTQEPSFSVSPGGTVTLTCGLSSGSVSTSYYPSWYQQTPGQAPRTLIYGTNTRSSGVPDRFSGSILGNKAALTITGAQADDESDYYCLLYMGPGISYVFGTGTKVTVL

SEQ ID NO: 537 - protein, 111 aa, Artificial Sequence
  Description of Artificial Sequence: Synthetic polypeptide
  V3-4_IGLJ1*01 V91L/S96P
QTVVTQEPSFSVSPGGTVTLTCGLSSGSVSTSYYPSWYQQTPGQAPRTLIYSTNTRSSGVPDRFSGSILGNKAALTITGAQADDESDYYCLLYMGPGISYVFGTGTKVTVL

SEQ ID NO: 538 - protein, 111 aa, Artificial Sequence
  Description of Artificial Sequence: Synthetic polypeptide
  V3-4_IGLJ1*01 V91L/S96P T53F
QTVVTQEPSFSVSPGGTVTLTCGLSSGSVSTSYYPSWYQQTPGQAPRTLIYSFNTRSSGVPDRFSGSILGNKAALTITGAQADDESDYYCLLYMGPGISYVFGTGTKVTVL

SEQ ID NO: 539 - protein, 111 aa, Artificial Sequence
  Description of Artificial Sequence: Synthetic polypeptide
  V3-4_IGLJ1*01 V91L/S96P T53L
QTVVTQEPSFSVSPGGTVTLTCGLSSGSVSTSYYPSWYQQTPGQAPRTLIYSLNTRSSGVPDRFSGSILGNKAALTITGAQADDESDYYCLLYMGPGISYVFGTGTKVTVL

SEQ ID NO: 540 - protein, 111 aa, Artificial Sequence
  Description of Artificial Sequence: Synthetic polypeptide
  V3-4_IGLJ1*01 V91L/S96P T53I
QTVVTQEPSFSVSPGGTVTLTCGLSSGSVSTSYYPSWYQQTPGQAPRTLIYSINTRSSGVPDRFSGSILGNKAALTITGAQADDESDYYCLLYMGPGISYVFGTGTKVTVL

SEQ ID NO: 541 - protein, 111 aa, Artificial Sequence
  Description of Artificial Sequence: Synthetic polypeptide
  V3-4_IGLJ1*01 V91L/S96P T53M
QTVVTQEPSFSVSPGGTVTLTCGLSSGSVSTSYYPSWYQQTPGQAPRTLIYSMNTRSSGVPDRFSGSILGNKAALTITGAQADDESDYYCLLYMGPGISYVFGTGTKVTVL

SEQ ID NO: 542 - protein, 111 aa, Artificial Sequence
  Description of Artificial Sequence: Synthetic polypeptide
  V3-4_IGLJ1*01 V91L/S96P T53V
QTVVTQEPSFSVSPGGTVTLTCGLSSGSVSTSYYPSWYQQTPGQAPRTLIYSVNTRSSGVPDRFSGSILGNKAALTITGAQADDESDYYCLLYMGPGISYVFGTGTKVTVL

SEQ ID NO: 543 - protein, 111 aa, Artificial Sequence
  Description of Artificial Sequence: Synthetic polypeptide
  V3-4_IGLJ1*01 V91L/S96P T53S
QTVVTQEPSFSVSPGGTVTLTCGLSSGSVSTSYYPSWYQQTPGQAPRTLIYSSNTRSSGVPDRFSGSILGNKAALTITGAQADDESDYYCLLYMGPGISYVFGTGTKVTVL

SEQ ID NO: 544 - protein, 111 aa, Artificial Sequence
  Description of Artificial Sequence: Synthetic polypeptide
  V3-4_IGLJ1*01 V91L/S96P T53P
QTVVTQEPSFSVSPGGTVTLTCGLSSGSVSTSYYPSWYQQTPGQAPRTLIYSPNTRSSGVPDRFSGSILGNKAALTITGAQADDESDYYCLLYMGPGISYVFGTGTKVTVL

SEQ ID NO: 545 - protein, 111 aa, Artificial Sequence
  Description of Artificial Sequence: Synthetic polypeptide
  V3-4_IGLJ1*01 V91L/S96P T53Y
QTVVTQEPSFSVSPGGTVTLTCGLSSGSVSTSYYPSWYQQTPGQAPRTLIYSYNTRSSGVPDRFSGSILGNKAALTITGAQADDESDYYCLLYMGPGISYVFGTGTKVTVL

SEQ ID NO: 546 - protein, 111 aa, Artificial Sequence
  Description of Artificial Sequence: Synthetic polypeptide
  V3-4_IGLJ1*01 V91L/S96P T53H
QTVVTQEPSFSVSPGGTVTLTCGLSSGSVSTSYYPSWYQQTPGQAPRTLIYSHNTRSSGVPDRFSGSILGNKAALTITGAQADDESDYYCLLYMGPGISYVFGTGTKVTVL

SEQ ID NO: 547 - protein, 111 aa, Artificial Sequence
  Description of Artificial Sequence: Synthetic polypeptide
  V3-4_IGLJ1*01 V91L/S96P T53Q
QTVVTQEPSFSVSPGGTVTLTCGLSSGSVSTSYYPSWYQQTPGQAPRTLIYSQNTRSSGVPDRFSGSILGNKAALTITGAQADDESDYYCLLYMGPGISYVFGTGTKVTVL

SEQ ID NO: 548 - protein, 111 aa, Artificial Sequence
  Description of Artificial Sequence: Synthetic polypeptide
  V3-4_IGLJ1*01 V91L/S96P T53N
QTVVTQEPSFSVSPGGTVTLTCGLSSGSVSTSYYPSWYQQTPGQAPRTLIYSNNTRSSGVPDRFSGSILGNKAALTITGAQADDESDYYCLLYMGPGISYVFGTGTKVTVL

SEQ ID NO: 549 - protein, 111 aa, Artificial Sequence
  Description of Artificial Sequence: Synthetic polypeptide
  V3-4_IGLJ1*01 V91L/S96P T53K
QTVVTQEPSFSVSPGGTVTLTCGLSSGSVSTSYYPSWYQQTPGQAPRTLIYSKNTRSSGVPDRFSGSILGNKAALTITGAQADDESDYYCLLYMGPGISYVFGTGTKVTVL

SEQ ID NO: 550 - protein, 111 aa, Artificial Sequence
  Description of Artificial Sequence: Synthetic polypeptide
  V3-4_IGLJ1*01 V91L/S96P T53D
QTVVTQEPSFSVSPGGTVTLTCGLSSGSVSTSYYPSWYQQTPGQAPRTLIYSDNTRSSGVPDRFSGSILGNKAALTITGAQADDESDYYCLLYMGPGISYVFGTGTKVTVL

SEQ ID NO: 551 - protein, 111 aa, Artificial Sequence
  Description of Artificial Sequence: Synthetic polypeptide
  V3-4_IGLJ1*01 V91L/S96P T53E
QTVVTQEPSFSVSPGGTVTLTCGLSSGSVSTSYYPSWYQQTPGQAPRTLIYSENTRSSGVPDRFSGSILGNKAALTITGAQADDESDYYCLLYMGPGISYVFGTGTKVTVL

SEQ ID NO: 552 - protein, 111 aa, Artificial Sequence
  Description of Artificial Sequence: Synthetic polypeptide
  V3-4_IGLJ1*01 V91L/S96P T53W
QTVVTQEPSFSVSPGGTVTLTCGLSSGSVSTSYYPSWYQQTPGQAPRTLIYSWNTRSSGVPDRFSGSILGNKAALTITGAQADDESDYYCLLYMGPGISYVFGTGTKVTVL

SEQ ID NO: 553 - protein, 111 aa, Artificial Sequence
  Description of Artificial Sequence: Synthetic polypeptide
  V3-4_IGLJ1*01 V91L/S96P T53R
QTVVTQEPSFSVSPGGTVTLTCGLSSGSVSTSYYPSWYQQTPGQAPRTLIYSRNTRSSGVPDRFSGSILGNKAALTITGAQADDESDYYCLLYMGPGISYVFGTGTKVTVL

SEQ ID NO: 554 - protein, 111 aa, Artificial Sequence
  Description of Artificial Sequence: Synthetic polypeptide
  V3-4_IGLJ1*01 V91L/S96P T53G
QTVVTQEPSFSVSPGGTVTLTCGLSSGSVSTSYYPSWYQQTPGQAPRTLIYSGNTRSSGVPDRFSGSILGNKAALTITGAQADDESDYYCLLYMGPGISYVFGTGTKVTVL

SEQ ID NO: 555 - protein, 111 aa, Artificial Sequence
  Description of Artificial Sequence: Synthetic polypeptide
  V3-4_IGLJ1*01 V91L/S96P S57F
QTVVTQEPSFSVSPGGTVTLTCGLSSGSVSTSYYPSWYQQTPGQAPRTLIYSTNTRFSGVPDRFSGSILGNKAALTITGAQADDESDYYCLLYMGPGISYVFGTGTKVTVL

SEQ ID NO: 556 - protein, 111 aa, Artificial Sequence
  Description of Artificial Sequence: Synthetic polypeptide
  V3-4_IGLJ1*01 V91L/S96P S57L
QTVVTQEPSFSVSPGGTVTLTCGLSSGSVSTSYYPSWYQQTPGQAPRTLIYSTNTRLSGVPDRFSGSILGNKAALTITGAQADDESDYYCLLYMGPGISYVFGTGTKVTVL

SEQ ID NO: 557 - protein, 111 aa, Artificial Sequence
  Description of Artificial Sequence: Synthetic polypeptide
  V3-4_IGLJ1*01 V91L/S96P S57I
QTVVTQEPSFSVSPGGTVTLTCGLSSGSVSTSYYPSWYQQTPGQAPRTLIYSTNTRISGVPDRFSGSILGNKAALTITGAQADDESDYYCLLYMGPGISYVFGTGTKVTVL

SEQ ID NO: 558 - protein, 111 aa, Artificial Sequence
  Description of Artificial Sequence: Synthetic polypeptide
  V3-4_IGLJ1*01 V91L/S96P S57M
QTVVTQEPSFSVSPGGTVTLTCGLSSGSVSTSYYPSWYQQTPGQAPRTLIYSTNTRMSGVPDRFSGSILGNKAALTITGAQADDESDYYCLLYMGPGISYVFGTGTKVTVL

SEQ ID NO: 559 - protein, 111 aa, Artificial Sequence
  Description of Artificial Sequence: Synthetic polypeptide
  V3-4_IGLJ1*01 V91L/S96P S57V
QTVVTQEPSFSVSPGGTVTLTCGLSSGSVSTSYYPSWYQQTPGQAPRTLIYSTNTRVSGVPDRFSGSILGNKAALTITGAQADDESDYYCLLYMGPGISYVFGTGTKVTVL

SEQ ID NO: 560 - protein, 111 aa, Artificial Sequence
  Description of Artificial Sequence: Synthetic polypeptide
  V3-4_IGLJ1*01 V91L/S96P S57P
QTVVTQEPSFSVSPGGTVTLTCGLSSGSVSTSYYPSWYQQTPGQAPRTLIYSTNTRPSGVPDRFSGSILGNKAALTITGAQADDESDYYCLLYMGPGISYVFGTGTKVTVL

SEQ ID NO: 561 - protein, 111 aa, Artificial Sequence
  Description of Artificial Sequence: Synthetic polypeptide
  V3-4_IGLJ1*01 V91L/S96P S57T
QTVVTQEPSFSVSPGGTVTLTCGLSSGSVSTSYYPSWYQQTPGQAPRTLIYSTNTRTSGVPDRFSGSILGNKAALTITGAQADDESDYYCLLYMGPGISYVFGTGTKVTVL

SEQ ID NO: 562 - protein, 111 aa, Artificial Sequence
  Description of Artificial Sequence: Synthetic polypeptide
  V3-4_IGLJ1*01 V91L/S96P S57Y
QTVVTQEPSFSVSPGGTVTLTCGLSSGSVSTSYYPSWYQQTPGQAPRTLIYSTNTRYSGVPDRFSGSILGNKAALTITGAQADDESDYYCLLYMGPGISYVFGTGTKVTVL

SEQ ID NO: 563 - protein, 111 aa, Artificial Sequence
  Description of Artificial Sequence: Synthetic polypeptide
  V3-4_IGLJ1*01 V91L/S96P S57H
QTVVTQEPSFSVSPGGTVTLTCGLSSGSVSTSYYPSWYQQTPGQAPRTLIYSTNTRHSGVPDRFSGSILGNKAALTITGAQADDESDYYCLLYMGPGISYVFGTGTKVTVL

SEQ ID NO: 564 - protein, 111 aa, Artificial Sequence
  Description of Artificial Sequence: Synthetic polypeptide
  V3-4_IGLJ1*01 V91L/S96P S57Q
QTVVTQEPSFSVSPGGTVTLTCGLSSGSVSTSYYPSWYQQTPGQAPRTLIYSTNTRQSGVPDRFSGSILGNKAALTITGAQADDESDYYCLLYMGPGISYVFGTGTKVTVL

SEQ ID NO: 565 - protein, 111 aa, Artificial Sequence
  Description of Artificial Sequence: Synthetic polypeptide
  V3-4_IGLJ1*01 V91L/S96P S57N
QTVVTQEPSFSVSPGGTVTLTCGLSSGSVSTSYYPSWYQQTPGQAPRTLIYSTNTRNSGVPDRFSGSILGNKAALTITGAQADDESDYYCLLYMGPGISYVFGTGTKVTVL

SEQ ID NO: 566 - protein, 111 aa, Artificial Sequence
  Description of Artificial Sequence: Synthetic polypeptide
  V3-4_IGLJ1*01 V91L/S96P S57K
QTVVTQEPSFSVSPGGTVTLTCGLSSGSVSTSYYPSWYQQTPGQAPRTLIYSTNTRKSGVPDRFSGSILGNKAALTITGAQADDESDYYCLLYMGPGISYVFGTGTKVTVL

SEQ ID NO: 567 - protein, 111 aa, Artificial Sequence
  Description of Artificial Sequence: Synthetic polypeptide
  V3-4_IGLJ1*01 V91L/S96P S57D
QTVVTQEPSFSVSPGGTVTLTCGLSSGSVSTSYYPSWYQQTPGQAPRTLIYSTNTRDSGVPDRFSGSILGNKAALTITGAQADDESDYYCLLYMGPGISYVFGTGTKVTVL

SEQ ID NO: 568 - protein, 111 aa, Artificial Sequence
  Description of Artificial Sequence: Synthetic polypeptide
  V3-4_IGLJ1*01 V91L/S96P S57E
QTVVTQEPSFSVSPGGTVTLTCGLSSGSVSTSYYPSWYQQTPGQAPRTLIYSTNTRESGVPDRFSGSILGNKAALTITGAQADDESDYYCLLYMGPGISYVFGTGTKVTVL

SEQ ID NO: 569 - protein, 111 aa, Artificial Sequence
  Description of Artificial Sequence: Synthetic polypeptide
  V3-4_IGLJ1*01 V91L/S96P S57W
QTVVTQEPSFSVSPGGTVTLTCGLSSGSVSTSYYPSWYQQTPGQAPRTLIYSTNTRWSGVPDRFSGSILGNKAALTITGAQADDESDYYCLLYMGPGISYVFGTGTKVTVL

SEQ ID NO: 570 - protein, 111 aa, Artificial Sequence
  Description of Artificial Sequence: Synthetic polypeptide
  V3-4_IGLJ1*01 V91L/S96P S57R
QTVVTQEPSFSVSPGGTVTLTCGLSSGSVSTSYYPSWYQQTPGQAPRTLIYSTNTRRSGVPDRFSGSILGNKAALTITGAQADDESDYYCLLYMGPGISYVFGTGTKVTVL

SEQ ID NO: 571 - protein, 111 aa, Artificial Sequence
  Description of Artificial Sequence: Synthetic polypeptide
  V3-4_IGLJ1*01 V91L/S96P S57G
QTVVTQEPSFSVSPGGTVTLTCGLSSGSVSTSYYPSWYQQTPGQAPRTLIYSTNTRGSGVPDRFSGSILGNKAALTITGAQADDESDYYCLLYMGPGISYVFGTGTKVTVL

SEQ ID NO: 572 - protein, 125 aa, Artificial Sequence
  Description of Artificial Sequence: Synthetic polypeptide
  VH1-69_IGHD1-1*01_IGHJ6*01
QVQLVQSGAEVKKPGSSVKVSCKASGGTFSSYAISWVRQAPGQGLEWMGGIIPIFGTANYAQKFQGRVTITADKSTSTAYMELSSLRSEDTAVYYCARGYNWNDDYYYYYGMDVWGQGTTVTVSS

SEQ ID NO: 573 - protein, 113 aa, Artificial Sequence
  Description of Artificial Sequence: Synthetic polypeptide
  A17_IGKJ1*01
DVVMTQSPLSLPVTLGQPASISCRSSQSLVYSDGNTYLNWFQQRPGQSPRRLIYKVSNRDSGVPDRFSGSGSGTDFTLKISRVEAEDVGVYYCMQGTHWPPWTFGQGTKVEIK

SEQ ID NO: 574 - DNA, 296 bp, Homo sapiens
  IGHV1-18*01
caggttcagctggtgcagtctggagctgaggtgaagaagcctggggcctcagtgaaggtctcctgcaaggcttctggttacacctttaccagctatggtatcagctgggtgcgacaggcccctggacaagggcttgagtggatgggatggatcagcgcttacaatggtaacacaaactatgcacagaagctccagggcagagtcaccatgaccacagacacatccacgagcacagcctacatggagctgaggagcctgagatctgacgacacggccgtgtattactgtgcgagaga

SEQ ID NO: 575 - DNA, 276 bp, Homo sapiens
  IGHV1-18*02
caggttcagctggtgcagtctggagctgaggtgaagaagcctggggcctcagtgaaggtctcctgcaaggcttctggttacacctttaccagctatggtatcagctgggtgcgacaggcccctggacaagggcttgagtggatgggatggatcagcgcttacaatggtaacacaaactatgcacagaagctccagggcagagtcaccatgaccacagacacatccacgagcacagcctacatggagctgaggagcctaagatctgacgacacggcc

SEQ ID NO: 576 - DNA, 296 bp, Homo sapiens
  IGHV1-2*01
caggtgcagctggtgcagtctggggctgaggtgaagaagcctggggcctcagtgaaggtctcctgcaaggcttctggatacaccttcaccggctactatatgcactgggtgcgacaggcccctggacaagggcttgagtggatgggacggatcaaccctaacagtggtggcacaaactatgcacagaagtttcagggcagggtcaccagtaccagggacacgtccatcagcacagcctacatggagctgagcaggctgagatctgacgacacggtcgtgtattactgtgcgagaga

SEQ ID NO: 577 - DNA, 296 bp, Homo sapiens
  IGHV1-2*02
caggtgcagctggtgcagtctggggctgaggtgaagaagcctggggcctcagtgaaggtctcctgcaaggcttctggatacaccttcaccggctactatatgcactgggtgcgacaggcccctggacaagggcttgagtggatgggatggatcaaccctaacagtggtggcacaaactatgcacagaagtttcagggcagggtcaccatgaccagggacacgtccatcagcacagcctacatggagctgagcaggctgagatctgacgacacggccgtgtattactgtgcgagaga

SEQ ID NO: 578 - DNA, 296 bp, Homo sapiens
  IGHV1-2*03
  modified_base (113)..(113): a, c, t or g
caggtgcagctggtgcagtctggggctgaggtgaagaagcttggggcctcagtgaaggtctcctgcaaggcttctggatacaccttcaccggctactatatgcactgggtgcnacaggcccctggacaagggcttgagtggatgggatggatcaaccctaacagtggtggcacaaactatgcacagaagtttcagggcagggtcaccatgaccagggacacgtccatcagcacagcctacatggagctgagcaggctgagatctgacgacacggccgtgtattactgtgcgagaga

SEQ ID NO: 579 - DNA, 294 bp, Homo sapiens
  IGHV1-2*04
caggtgcagctggtgcagtctggggctgaggtgaagaagcctggggcctcagtgaaggtctcctgcaaggcttctggatacaccttcaccggctactatatgcactgggtgcgacaggcccctggacaagggcttgagtggatgggatggatcaaccctaacagtggtggcacaaactatgcacagaagtttcagggctgggtcaccatgaccagggacacgtccatcagcacagcctacatggagctgagcaggctgagatctgacgacacggccgtgtattactgtgcgaga

SEQ ID NO: 580 - DNA, 296 bp, Homo sapiens
  IGHV1-24*01
caggtccagctggtacagtctggggctgaggtgaagaagcctggggcctcagtgaaggtctcctgcaaggtttccggatacaccctcactgaattatccatgcactgggtgcgacaggctcctggaaaagggcttgagtggatgggaggttttgatcctgaagatggtgaaacaatctacgcacagaagttccagggcagagtcaccatgaccgaggacacatctacagacacagcctacatggagctgagcagcctgagatctgaggacacggccgtgtattactgtgcaacaga

SEQ ID NO: 581 - DNA, 296 bp, Homo sapiens
  IGHV1-3*01
caggtccagcttgtgcagtctggggctgaggtgaagaagcctggggcctcagtgaaggtttcctgcaaggcttctggatacaccttcactagctatgctatgcattgggtgcgccaggcccccggacaaaggcttgagtggatgggatggatcaacgctggcaatggtaacacaaaatattcacagaagttccagggcagagtcaccattaccagggacacatccgcgagcacagcctacatggagctgagcagcctgagatctgaagacacggctgtgtattactgtgcgagaga

SEQ ID NO: 582 - DNA, 296 bp, Homo sapiens
  IGHV1-3*02
caggttcagctggtgcagtctggggctgaggtgaagaagcctggggcctcagtgaaggtttcctgcaaggcttctggatacaccttcactagctatgctatgcattgggtgcgccaggcccccggacaaaggcttgagtggatgggatggagcaacgctggcaatggtaacacaaaatattcacaggagttccagggcagagtcaccattaccagggacacatccgcgagcacagcctacatggagctgagcagcctgagatctgaggacatggctgtgtattactgtgcgagaga

SEQ ID NO: 583 - DNA, 294 bp, Homo sapiens
  IGHV1-45*01
cagatgcagctggtgcagtctggggctgaggtgaagaagactgggtcctcagtgaaggtttcctgcaaggcttccggatacaccttcacctaccgctacctgcactgggtgcgacaggcccccggacaagcgcttgagtggatgggatggatcacacctttcaatggtaacaccaactacgcacagaaattccaggacagagtcaccattactagggacaggtctatgagcacagcctacatggagctgagcagcctgagatctgaggacacagccatgtattactgtgcaaga

SEQ ID NO: 584 - DNA, 294 bp, Homo sapiens
  IGHV1-45*02
cagatgcagctggtgcagtctggggctgaggtgaagaagactgggtcctcagtgaaggtttcctgcaaggcttccggatacaccttcacctaccgctacctgcactgggtgcgacaggcccccggacaagcgcttgagtggatgggatggatcacacctttcaatggtaacaccaactacgcacagaaattccaggacagagtcaccattaccagggacaggtctatgagcacagcctacatggagctgagcagcctgagatctgaggacacagccatgtattactgtgcaaga

SEQ ID NO: 585 - DNA, 260 bp, Homo sapiens
  IGHV1-45*03
agaagactgggtcctcagtgaaggtttcctgcaaggcttccggatacaccttcacctaccgctacctgcactgggtgcgacaggcccccagacaagcgcttgagtggatgggatggatcacacctttcaatggtaacaccaactacgcacagaaattccaggacagagtcaccattaccagggacaggtctatgagcacagcctacatggagctgagcagcctgagatctgaggacacagccatgtattactgtgcaaga

SEQ ID NO: 586 - DNA, 296 bp, Homo sapiens
  IGHV1-46*01
caggtgcagctggtgcagtctggggctgaggtgaagaagcctggggcctcagtgaaggtttcctgcaaggcatctggatacaccttcaccagctactatatgcactgggtgcgacaggcccctggacaagggcttgagtggatgggaataatcaaccctagtggtggtagcacaagctacgcacagaagttccagggcagagtcaccatgaccagggacacgtccacgagcacagtctacatggagctgagcagcctgagatctgaggacacggccgtgtattactgtgcgagaga

SEQ ID NO: 587 - DNA, 296 bp, Homo sapiens
  IGHV1-46*02
caggtgcagctggtgcagtctggggctgaggtgaagaagcctggggcctcagtgaaggtttcctgcaaggcatctggatacaccttcaacagctactatatgcactgggtgcgacaggcccctggacaagggcttgagtggatgggaataatcaaccctagtggtggtagcacaagctacgcacagaagttccagggcagagtcaccatgaccagggacacgtccacgagcacagtctacatggagctgagcagcctgagatctgaggacacggccgtgtattactgtgcgagaga

SEQ ID NO: 588 - DNA, 296 bp, Homo sapiens
  IGHV1-46*03
caggtgcagctggtgcagtctggggctgaggtgaagaagcctggggcctcagtgaaggtttcctgcaaggcatctggatacaccttcaccagctactatatgcactgggtgcgacaggcccctggacaagggcttgagtggatgggaataatcaaccctagtggtggtagcacaagctacgcacagaagttccagggcagagtcaccatgaccagggacacgtccacgagcacagtctacatggagctgagcagcctgagatctgaggacacggccgtgtattactgtgctagaga

SEQ ID NO: 589 - DNA, 296 bp, Homo sapiens
  IGHV1-58*01
caaatgcagctggtgcagtctgggcctgaggtgaagaagcctgggacctcagtgaaggtctcctgcaaggcttctggattcacctttactagctctgctgtgcagtgggtgcgacaggctcgtggacaacgccttgagtggataggatggatcgtcgttggcagtggtaacacaaactacgcacagaagttccaggaaagagtcaccattaccagggacatgtccacaagcacagcctacatggagctgagcagcctgagatccgaggacacggccgtgtattactgtgcggcaga

SEQ ID NO: 590 - DNA, 296 bp, Homo sapiens
  IGHV1-58*02
caaatgcagctggtgcagtctgggcctgaggtgaagaagcctgggacctcagtgaaggtctcctgcaaggcttctggattcacctttactagctctgctatgcagtgggtgcgacaggctcgtggacaacgccttgagtggataggatggatcgtcgttggcagtggtaacacaaactacgcacagaagttccaggaaagagtcaccattaccagggacatgtccacaagcacagcctacatggagctgagcagcctgagatccgaggacacggccgtgtattactgtgcggcaga

SEQ ID NO: 591 - DNA, 296 bp, Homo sapiens
  IGHV1-69*01
caggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacgaatccacgagcacagcctacatggagctgagcagcctgagatctgaggacacggccgtgtattactgtgcgagaga

SEQ ID NO: 592 - DNA, 294 bp, Homo sapiens
  IGHV1-69*02
caggtccagctggtgcaatctggggctgaggtgaagaagcctgggtcctcggtgaaggtctcctgcaaggcttctggaggcaccttcagcagctatactatcagctgggtgcgacaggcccctggacaagggcttgagtggatgggaaggatcatccctatccttggtatagcaaactacgcacagaagttccagggcagagtcacgattaccgcggacaaatccacgagcacagcctacatggagctgagcagcctgagatctgaggacacggccgtgtattactgtgcgaga

SEQ ID NO: 593 - DNA, 275 bp, Homo sapiens
  IGHV1-69*03
caggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacgaatccacgagcacagcctacatggagctgagcagcctgagatctgatgacacggc

SEQ ID NO: 594 - DNA, 296 bp, Homo sapiens
  IGHV1-69*04
caggtccagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggaaggatcatccctatccttggtatagcaaactacgcacagaagttccagggcagagtcacgattaccgcggacaaatccacgagcacagcctacatggagctgagcagcctgagatctgaggacacggccgtgtattactgtgcgagaga

SEQ ID NO: 595 - DNA, 294 bp, Homo sapiens
  IGHV1-69*05
caggtccagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccacggacgaatccacgagcacagcctacatggagctgagcagcctgagatctgaggacacggccgtgtattactgtgcgaga

SEQ ID NO: 596 - DNA, 296 bp, Homo sapiens
  IGHV1-69*06
caggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacaaatccacgagcacagcctacatggagctgagcagcctgagatctgaggacacggccgtgtattactgtgcgagaga

SEQ ID NO: 597 - DNA, 233 bp, Homo sapiens
  IGHV1-69*07
agaagcctgggtcctcggtgaaggtctcctgcaaggcttctggaggcaccttcagcagctatgctatcagctgggtgcgacaggcccctggacaagggcttgagtggatgggaaggatcatccctatctttggtacagcaaactacgcacagaagttccagggcagagtcacgattaccgcggacgaatccacgagcacagcctacatggagctgagcagcctgagatctgag

SEQ ID NO: 598 - DNA, 296 bp, Homo sapiens
  IGHV1-69*08
caggtccagctggtgcaatctggggctgaggtgaagaagcctgggtcctcggtgaaggtctcctgcaaggcttctggaggcaccttcagcagctatactatcagctgggtgcgacaggcccctggacaagggcttgagtggatgggaaggatcatccctatccttggtacagcaaactacgcacagaagttccagggcagagtcacgattaccgcggacaaatccacgagcacagcctacatggagctgagcagcctgagatctgaggacacggccgtgtattactgtgcgagaga

SEQ ID NO: 599 - DNA, 296 bp, Homo sapiens
  IGHV1-69*09
caggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggaaggatcatccctatccttggtatagcaaactacgcacagaagttccagggcagagtcacgattaccgcggacaaatccacgagcacagcctacatggagctgagcagcctgagatctgaggacacggccgtgtattactgtgcgagaga

SEQ ID NO: 600 - DNA, 296 bp, Homo sapiens
  IGHV1-69*10
caggtccagctggtgcagtctggggctgaggtgaagaagcctgggtcctcagtgaaggtctcctgcaaggcttctggaggcaccttcagcagctatgctatcagctgggtgcgacaggcccctggacaagggcttgagtggatgggagggatcatccctatccttggtatagcaaactacgcacagaagttccagggcagagtcacgattaccgcggacaaatccacgagcacagcctacatggagctgagcagcctgagatctgaggacacggccgtgtattactgtgcgagaga

SEQ ID NO: 601 - DNA, 296 bp, Homo sapiens
  IGHV1-69*11
caggtccagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggaaggatcatccctatccttggtacagcaaactacgcacagaagttccagggcagagtcacgattaccgcggacgaatccacgagcacagcctacatggagctgagcagcctgagatctgaggacacggccgtgtattactgtgcgagaga

SEQ ID NO: 602 - DNA, 296 bp, Homo sapiens
  IGHV1-69*12
caggtccagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacgaatccacgagcacagcctacatggagctgagcagcctgagatctgaggacacggccgtgtattactgtgcgagaga

SEQ ID NO: 603 - DNA, 296 bp, Homo sapiens
  IGHV1-69*13
caggtccagctggtgcagtctggggctgaggtgaagaagcctgggtcctcagtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacgaatccacgagcacagcctacatggagctgagcagcctgagatctgaggacacggccgtgtattactgtgcgagaga

SEQ ID NO: 604 - DNA, 296 bp, Homo sapiens
  IGHV1-8*01
caggtgcagctggtgcagtctggggctgaggtgaagaagcctggggcctcagtgaaggtctcctgcaaggcttctggatacaccttcaccagttatgatatcaactgggtgcgacaggccactggacaagggcttgagtggatgggatggatgaaccctaacagtggtaacacaggctatgcacagaagttccagggcagagtcaccatgaccaggaacacctccataagcacagcctacatggagctgagcagcctgagatctgaggacacggccgtgtattactgtgcgagagg

SEQ ID NO: 605 - DNA, 260 bp, Homo sapiens
  IGHV1-c*01
ggaagtctggggcctcagtgaaagtctcctgtagtttttctgggtttaccatcaccagctacggtatacattgggtgcaacagtcccctggacaagggcttgagtggatgggatggatcaaccctggcaatggtagcccaagctatgccaagaagtttcagggcagattcaccatgaccagggacatgtccacaaccacagcctacacagacctgagcagcctgacatctgaggacatggctgtgtattactatgcaaga

SEQ ID NO: 606 - DNA, 294 bp, Homo sapiens
  IGHV1-f*01
gaggtccagctggtacagtctggggctgaggtgaagaagcctggggctacagtgaaaatctcctgcaaggtttctggatacaccttcaccgactactacatgcactgggtgcaacaggcccctggaaaagggcttgagtggatgggacttgttgatcctgaagatggtgaaacaatatacgcagagaagttccagggcagagtcaccataaccgcggacacgtctacagacacagcctacatggagctgagcagcctgagatctgaggacacggccgtgtattactgtgcaaca

SEQ ID NO: 607 - DNA, 233 bp, Homo sapiens
  IGHV1-f*02
agaagcctggggctacagtgaaaatctcctgcaaggtttctggatacaccttcaccgactactacatgcactgggtgcaacaggcccctggaaaagggcttgagtggatgggacttgttgatcctgaagatggtgaaacaatatatgcagagaagttccagggcagagtcaccataaccgcggacacgtctacagacacagcctacatggagctgagcagcctgagatctgag

SEQ ID NO: 608 - DNA, 296 bp, Homo sapiens
  IGHV4-28*01
caggtgcagctgcaggagtcgggcccaggactggtgaagccttcggacaccctgtccctcacctgcgctgtctctggttactccatcagcagtagtaactggtggggctggatccggcagcccccagggaagggactggagtggattgggtacatctattatagtgggagcacctactacaacccgtccctcaagagtcgagtcaccatgtcagtagacacgtccaagaaccagttctccctgaagctgagctctgtgaccgccgtggacacggccgtgtattactgtgcgagaaa

SEQ ID NO: 609 - DNA, 296 bp, Homo sapiens
  IGHV4-28*02
caggtgcagctgcaggagtcgggcccaggactggtgaagccttcacagaccctgtccctcacctgcgctgtctctggttactccatcagcagtagtaactggtggggctggatccggcagcccccagggaagggactggagtggattgggtacatctattatagtgggagcatctactacaacccgtccctcaagagtcgagtcaccatgtcagtagacacgtccaagaaccagttctccctgaagctgagctctgtgaccgccgtggacacggccgtgtattactgtgcgagaaa

SEQ ID NO: 610 - DNA, 296 bp, Homo sapiens
  IGHV4-28*03
caggtgcagctgcaggagtcgggcccaggactggtgaagccttcggacaccctgtccctcacctgcgctgtctctggttactccatcagcagtagtaactggtggggctggatccggcagcccccagggaagggactggagtggattgggtacatctattatagtgggagcacctactacaacccgtccctcaagagtcgagtcaccatgtcagtagacacgtccaagaaccagttctccctgaagctgagctctgtgaccgccgtggacacggccgtgtattactgtgcgagaga

SEQ ID NO: 611 - DNA, 294 bp, Homo sapiens
  IGHV4-28*04
caggtgcagctgcaggagtcgggcccaggactggtgaagccttcggacaccctgtccctcacctgcgctgtctctggttactccatcagcagtagtaactggtggggctggatccggcagcccccagggaagggactggagtggattgggtacatctattatagtgggagcacctactacaacccgtccctcaagagtcgagtcaccatgtcagtagacacgtccaagaaccagttctccctgaagctgagctctgtgaccgccgtggacaccggcgtgtattactgtgcgaga

SEQ ID NO: 612 - DNA, 287 bp, Homo sapiens
  IGHV4-28*05
caggtgcagctgcaggagtcgggcccaggactggtgaagccttcggacaccctgtccctcacctgcgctgtctctggttactccatcagcagtagtaactggtggggctggatccggcagcccccagggaagggactggagtggattgggtacatctattatagtgggagcatctactacaacccgtccctcaagagtcgagtcaccatgtcagtagacacgtccaagaaccagttctccctgaagctgagctctgtgaccgccgtggacacggccgtgtattactg

SEQ ID NO: 613 - DNA, 299 bp, Homo sapiens
  IGHV4-30-2*01
cagctgcagctgcaggagtccggctcaggactggtgaagccttcacagaccctgtccctcacctgcgctgtctctggtggctccatcagcagtggtggttactcctggagctggatccggcagccaccagggaagggcctggagtggattgggtacatctatcatagtgggagcacctactacaacccgtccctcaagagtcgagtcaccatatcagtagacaggtccaagaaccagttctccctgaagctgagctctgtgaccgccgcggacacggccgtgtattactgtgccagaga

SEQ ID NO: 614 - DNA, 294 bp, Homo sapiens
  IGHV4-30-2*02
cagctgcagctgcaggagtccggctcaggactggtgaagccttcacagaccctgtccctcacctgcgctgtctctggtggctccatcagcagtggtggttactcctggagctggatccggcagccaccagggaagggcctggagtggattgggtacatctatcatagtgggagcacctactacaacccgtccctcaagagtcgagtcaccatatcagtagacaggtccaagaaccagttctccctgaagctgagctctgtgaccgctgcggacacggccgtgtattactgtgcg

SEQ ID NO: 615 - DNA, 299 bp, Homo sapiens
  IGHV4-30-2*03
cagctgcagctgcaggagtccggctcaggactggtgaagccttcacagaccctgtccctcacctgcgctgtctctggtggctccatcagcagtggtggttactcctggagctggatccggcagccaccagggaagggcctggagtggattgggagtatctattatagtgggagcacctactacaacccgtccctcaagagtcgagtcaccatatccgtagacacgtccaagaaccagttctccctgaagctgagctctgtgaccgctgcagacacggctgtgtattactgtgcgagaca

SEQ ID NO: 616 - DNA, 227 bp, Homo sapiens
  IGHV4-30-2*04
tctggtggctccatcagcagtggtggttactcctggagctggatccggcagccaccagggaagggcctggagtggattgggtacatctatcatagtgggagcacctactacaacccgtccctcaagagtcgagtcaccatatcagtagacacgtccaagaaccagttctccctgaagctgagctctgtgaccgccgcagacacggccgtgtattactgtgcgagaga

SEQ ID NO: 617 - DNA, 299 bp, Homo sapiens
  IGHV4-30-4*01
caggtgcagctgcaggagtcgggcccaggactggtgaagccttcacagaccctgtccctcacctgcactgtctctggtggctccatcagcagtggtgattactactggagttggatccgccagcccccagggaagggcctggagtggattgggtacatctattacagtgggagcacctactacaacccgtccctcaagagtcgagttaccatatcagtagacacgtccaagaaccagttctccctgaagctgagctctgtgactgccgcagacacggccgtgtattactgtgccagaga

SEQ ID NO: 618 - DNA, 299 bp, Homo sapiens
  IGHV4-30-4*02
caggtgcagctgcaggagtcgggcccaggactggtgaagccttcggacaccctgtccctcacctgcactgtctctggtggctccatcagcagtggtgattactactggagttggatccgccagcccccagggaagggcctggagtggattgggtacatctattacagtgggagcacctactacaacccgtccctcaagagtcgagttaccatatcagtagacacgtccaagaaccagttctccctgaagctgagctctgtgactgcagcagacacggccgtgtattactgtgccagaga

SEQ ID NO: 619 - DNA, 290 bp, Homo sapiens
  IGHV4-30-4*03
caggtgcagctgcaggagtcgggcccaggactggtgaagccttcacagaccctgtccctcacctgcactgtctctggtggctccatcagcagtggtgattactactggagttggatccgccagcccccagggaagggcctggagtggattgggtacatctattacagtgggagcacctactacaacccgtccctcaagagtcgagttaccatatcagtagacacgtccaagaaccagttctccctgaagctgagctctgtgactgccgcggacacggccgtgtattactg

SEQ ID NO: 620 - DNA, 290 bp, Homo sapiens
  IGHV4-30-4*04
caggtgcagctgcaggactcgggcccaggactggtgaagccttcacagaccctgtccctcacctgcactgtctctggtggctccatcagcagtggtgattactactggagttggatccgccagcccccagggaagggcctggagtggattgggtacttctattacagtgggagcacctactacaacccgtccctcaagagtcgagttaccatatcagtagacacgtccaagaaccagttctccctgaagctgagctctgtgactgccgcagacacggccgtgtattactg

SEQ ID NO: 621 - DNA, 228 bp, Homo sapiens
  IGHV4-30-4*05
  modified_base (54)..(54): a, c, t or g
ctctggtggctccatcagcagtggtgattactactggagttggatccgccagcncccagggaagggcctggagtggattgggtacatctattacagtgggagcacctactacaacccgtccctcaagagtcgagtcaccatatcagtagacacgtccaagaaccagttctccctgaagctgagctctgtgactgccgcagacacggccgtgtattactgtgccagaga

SEQ ID NO: 622 - DNA, 227 bp, Homo sapiens
  IGHV4-30-4*06
tctggtggctccatcagcagtggtgattactactggagttggatccgccagcacccagggaagggcctggagtggattgggtacatctattacagtgggagcacctactacaacccgtccctcaagagtcgagttaccatatcagtagacacgtccaagaaccagttctccctgaagctgagctctgtgactgccgcagacacggccgtgtattactgtgccagaga

SEQ ID NO: 623 - DNA, 299 bp, Homo sapiens
  IGHV4-31*01
caggtgcagctgcaggagtcgggcccaggactggtgaagccttcacagaccctgtccctcacctgcactgtctctggtggctccatcagcagtggtggttactactggagctggatccgccagcacccagggaagggcctggagtggattgggtacatctattacagtgggagcacctactacaacccgtccctcaagagtctagttaccatatcagtagacacgtctaagaaccagttctccctgaagctgagctctgtgactgccgcggacacggccgtgtattactgtgcgagaga

SEQ ID NO: 624 - DNA, 299 bp, Homo sapiens
  IGHV4-31*02
caggtgcagctgcaggagtcgggcccaggactggtgaagccttcacagaccctgtccctcacctgtactgtctctggtggctccatcagcagtggtggttactactggagctggatccgccagcacccagggaagggcctggagtggattgggtacatctattacagtgggagcacctactacaacccgtccctcaagagtcgagttaccatatcagtagacacgtctaagaaccagttctccctgaagctgagctctgtgactgccgcggacacggccgtgtattactgtgcgagaga

SEQ ID NO: 625 - DNA, 299 bp, Homo sapiens
  IGHV4-31*03
caggtgcagctgcaggagtcgggcccaggactggtgaagccttcacagaccctgtccctcacctgcactgtctctggtggctccatcagcagtggtggttactactggagctggatccgccagcacccagggaagggcctggagtggattgggtacatctattacagtgggagcacctactacaacccgtccctcaagagtcgagttaccatatcagtagacacgtctaagaaccagttctccctgaagctgagctctgtgactgccgcggacacggccgtgtattactgtgcgagaga

SEQ ID NO: 626 - DNA, 294 bp, Homo sapiens
  IGHV4-31*04
caggtgcggctgcaggagtcgggcccaggactggtgaagccttcacagaccctgtccctcacctgcactgtctctggtggctccatcagcagtggtggttactactggagctggatccgccagcacccagggaagggcctggagtggattgggtacatctattacagtgggagcacctactacaacccgtccctcaagagtcgagttaccatatcagtagacacgtctaagaaccagttctccctgaagctgagctctgtgactgccgcggacacggccgtgtattactgtgcg

SEQ ID NO: 627 - DNA, 291 bp, Homo sapiens
  IGHV4-31*05
caggtgcagctgcaggagtcgggcccaggactggtgaagccttcacagaccctgtccctcacctgcactgtctctggtggctccatcagcagtggtggttactactggagctggatccgccagcacccagggaagggcctggagtggattgggtacatctattacagtgggagcacctactacaacccgtccctcaagagtcgagttaccatatcagtagacacgtctaagaaccagttctccctgaagctgagctctgtgaccgcggacgcggccgtgtattactgtgcg

SEQ ID NO: 628 - DNA, 290 bp, Homo sapiens
  IGHV4-31*06
caggtgcagctgcaggagtcgggcccaggactggtgaagccttcacagaccctgtccctcacctgcactgtctctggtggctccatcagcagtggtagttactactggagctggatccgccagcacccagggaagggcctggagtggattgggtacatctattacagtgggagcacctactacaacccgtccctcaagagtcgagttaccatatcagtagacacgtctaagaaccagttctccctgaagctgagctctgtgactgccgcggacacggccgtgtattactg

SEQ ID NO: 629 - DNA, 290 bp, Homo sapiens
  IGHV4-31*07
caggtgcagctgcaggagtcgggcccaggactggtgaagccttcacagaccctgtccctcacctgcactgtctctggtggatccatcagcagtggtggttactactggagctggatccgccagcacccagggaagggcctggagtggattgggtacatctattacagtgggagcacctactacaacccgtccctcaagagtcgagttaccatatcagtagacacgtctaagaaccagttctccctgaagctgagctctgtgactgccgcggacacggccgtgtattactg

SEQ ID NO: 630 - DNA, 290 bp, Homo sapiens
  IGHV4-31*08
caggtgcagctgcaggagtcgggcccaggactggtgaagccttcacagaccctgtccctcacctgcactgtctctggtggctccatcagcagtggtggttactactggagctggatccgccagcacccagggaagggcctggagtggattgggtacatctattacagtgggagcacctactacaacccgtccctcaagagtcgagttaccatatccgtagacacgtccaagaaccagttctccctgaagctgagctctgtgactgccgcggacacggccgtgtattactg

SEQ ID NO: 631 - DNA, 290 bp, Homo sapiens
  IGHV4-31*09
caggtgcagctgcaggagtcgggcccaggactggtgaagccttcacagaccctgtccctcacctgcactgtctctggtggctccatcagcagtggtggttactactggagctggatccgccagcacccagggaagggcctggagtggattgggtacatctattacagtgggagcacctactacaacccgtccctcaagagtcgagttaccatatcagtagacaagtccaagaaccagttctccctgaagctgagctctgtgaccgccgcggacacggccgtgtattactg

SEQ ID NO: 632 - DNA, 299 bp, Homo sapiens
  IGHV4-31*10
caggtgcagctgcaggagtcgggcccaggactgttgaagccttcacagaccctgtccctcacctgcactgtctctggtggctccatcagcagtggtggttactactggagctggatccgccagcacccagggaagggcctggagtggattgggtgcatctattacagtgggagcacctactacaacccgtccctcaagagtcgagttaccatatcagtagacccgtccaagaaccagttctccctgaagccgagctctgtgactgccgcggacacggccgtggattactgtgcgagaga

SEQ ID NO: 633 - DNA, 293 bp, Homo sapiens
  IGHV4-34*01
caggtgcagctacagcagtggggcgcaggactgttgaagccttcggagaccctgtccctcacctgcgctgtctatggtgggtccttcagtggttactactggagctggatccgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggctgtgtattactgtgcgagagg

SEQ ID NO: 634 - DNA, 293 bp, Homo sapiens
  IGHV4-34*02
caggtgcagctacaacagtggggcgcaggactgttgaagccttcggagaccctgtccctcacctgcgctgtctatggtgggtccttcagtggttactactggagctggatccgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggctgtgtattactgtgcgagagg

SEQ ID NO: 635 - DNA, 284 bp, Homo sapiens
  IGHV4-34*03
caggtgcagctacagcagtggggcgcaggactgttgaagccttcggagaccctgtccctcacctgcgctgtctatggtgggtccttcagtggttactactggagctggatccgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggccgtgtattactg

SEQ ID NO: 636 - DNA, 293 bp, Homo sapiens
  IGHV4-34*04
caggtgcagctacagcagtggggcgcaggactgttgaagccttcggagaccctgtccctcacctgcgctgtctatggtgggtccttcagtggttactactggagctggatccgccagcccccagggaaggggctggagtggattggggaaatcaatcatagtggaagcaccaacaacaacccgtccctcaagagtcgagccaccatatcagtagacacgtccaagaaccagttctccctgaagctgagctctgtgaccgccgcggacacggctgtgtattactgtgcgagagg

SEQ ID NO: 637 - DNA, 293 bp, Homo sapiens
  IGHV4-34*05
caggtgcagctacagcagtggggcgcaggactgttgaagccttcggagaccctgtccctcacctgcgctgtctatggtgggtccttcagtggttactactggtgctggatccgccagcccctagggaaggggctggagtggattggggaaatcaatcatagtggaagcaccaacaacaacccgtccctcaagagtcgagccaccatatcagtagacacgtccaagaaccagttctccctgaagctgagctctgtgaccgccgcggacacggctgtgtattactgtgcgagagg

SEQ ID NO: 638 - DNA, 284 bp, Homo sapiens
  IGHV4-34*06
caggtgcagctacagcagtggggcgcaggactgttgaagccttcggagaccctgtccctcacctgcgctgtctatggtgggtccttcagtggttactactggagctggatccgccagcccccagggaaggggctggagtggattggggaaatcaatcatagtggaagcaccaactacaacccgtccctcaagagtcgagtcaccatatcagtagacacgtccaagaaccagttctccctgaagctgggctctgtgaccgccgcggacacggccgtgtattactg

SEQ ID NO: 639 - DNA, 284 bp, Homo sapiens
  IGHV4-34*07
caggtgcagctacagcagtggggcgcaggactgttgaagccttcggagaccctgtccctcacctgcgctgtctatggtgggtccttcagtggttactactggagctggatccgccagcccccagggaaggggctggagtggattggggaaatcaaccatagtggaagcaccaactacaacccgtccctcaagagtcgagtcaccatatcagtagacacgtccaagaaccagttctccctgaagctgagctctgtgaccgccgcggacacggccgtgtattactg

SEQ ID NO: 640 - DNA, 288 bp, Homo sapiens
  IGHV4-34*08
caggtgcagctacagcagtggggcgcaggactgttgaagccttcggagaccctgtccctcacctgcgctgtctatggtgggaccttcagtggttactactggagctggatccgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggctgtgtattactgtgcg

SEQ ID NO: 641 - DNA, 293 bp, Homo sapiens
  IGHV4-34*09
caggtgcagctgcaggagtcgggcccaggactggtgaagccttcacagaccctgtccctcacctgcgctgtctatggtgggtccttcagtggttactactggagctggatccgccagcccccagggaagggactggagtggattggggaaatcaatcatagtggaagcaccaactacaacccgtccctcaagagtcgagttaccatatcagtagacacgtctaagaaccagttctccctgaagctgagctctgtgactgccgcggacacggccgtgtattactgtgcgagaga

SEQ ID NO: 642 - DNA, 293 bp, Homo sapiens
  IGHV4-34*10
caggtgcagctgcaggagtcgggcccaggactggtgaagccttcggagaccctgtccctcacctgcgctgtctatggtgggtccttcagtggttactactggagctggatccgccagcccccagggaagggactggagtggattggggaaatcaatcatagtggaagcaccaactacaacccgtccctcaagagtcgaatcaccatgtcagtagacacgtccaagaaccagttctacctgaagctgagctctgtgaccgccgcggacacggccgtgtattactgtgcgagata

SEQ ID NO: 643 - DNA, 293 bp, Homo sapiens
  IGHV4-34*11
caggtgcagctacagcagtggggcgcaggactgttgaagccttcggagaccctgtccctcacctgcgctgtctatggtgggtccgtcagtggttactactggagctggatccggcagcccccagggaaggggctggagtggattgggtatatctattatagtgggagcaccaacaacaacccctccctcaagagtcgagccaccatatcagtagacacgtccaagaaccagttctccctgaacctgagctctgtgaccgccgcggacacggccgtgtattgctgtgcgagaga

SEQ ID NO: 644 - DNA, 291 bp, Homo sapiens
  IGHV4-34*12
caggtgcagctacagcagtggggcgcaggactgttgaagccttcggagaccctgtccctcacctgcgctgtctatggtgggtccttcagtggttactactggagctggatccgccagcccccagggaaggggctggagtggattggggaaatcattcatagtggaagcaccaactacaacccgtccctcaagagtcgagtcaccatatcagtagacacgtccaagaaccagttctccctgaagctgagctctgtgaccgccgcggacacggctgtgtattactgtgcgaga

SEQ ID NO: 645 - DNA, 221 bp, Homo sapiens
  IGHV4-34*13
tatggtgggtccttcagtggttactactggagctggatccgccagcccccagggaaggggctggagtggattggggaaatcaatcatagtggaagcaccaactacaacccctccctcaagagtcgagtcaccatatcagtagacacgtccaagaaccagttctccctgaagctgagctctgtgaccgccgcggacacggctgtgtattactgtgcgagagg

SEQ ID NO: 646 - DNA, 299 bp, Homo sapiens
  IGHV4-39*01
cagctgcagctgcaggagtcgggcccaggactggtgaagccttcggagaccctgtccctcacctgcactgtctctggtggctccatcagcagtagtagttactactggggctggatccgccagcccccagggaaggggctggagtggattgggagtatctattatagtgggagcacctactacaacccgtccctcaagagtcgagtcaccatatccgtagacacgtccaagaaccagttctccctgaagctgagctctgtgaccgccgcagacacggctgtgtattactgtgcgagaca

SEQ ID NO: 647 - DNA, 299 bp, Homo sapiens
  IGHV4-39*02
cagctgcagctgcaggagtcgggcccaggactggtgaagccttcggagaccctgtccctcacctgcactgtctctggtggctccatcagcagtagtagttactactggggctggatccgccagcccccagggaaggggctggagtggattgggagtatctattatagtgggagcacctactacaacccgtccctcaagagtcgagtcaccatatccgtagacacgtccaagaaccacttctccctgaagctgagctctgtgaccgccgcagacacggctgtgtattactgtgcgagaga

SEQ ID NO: 648 - DNA, 290 bp, Homo sapiens
  IGHV4-39*03
cagctgcagctgcaggagtcgggcccaggactggtgaagccttcggagaccctgtccctcacctgcactgtctctggtggctccatcagcagtagtagttactactggggctggatccgccagcccccagggaaggggctggagtggattgggagtatctattatagtgggagcacctactacaacccgtccctcaagagtcgagtcaccatatccgtagacacgtccaagaaccagttctccctgaagctgagctctgtgaccgccgcagacacggccgtgtattactg

SEQ ID NO: 649 - DNA, 196 bp, Homo sapiens
  IGHV4-39*04
gctccatcagcagtagtagttactactggggctggatccgccagcccccagggaaggggctggagtggattgggagtatctattatagtgggagcacctactacaacccgtccctcaagagtcgagtcaccatatccgtagacacgtccaagaaccagttctccctgaagctgagctctgtgaccgccgcggacac

SEQ ID NO: 650 - DNA, 294 bp, Homo sapiens
  IGHV4-39*05
cagctgcagctgcaggagtcgggcccaggactggtgaagccttcggagaccccgtccctcacctgcactgtctctggtggctccatcagcagtagtagttactactggggctggatccgccagcccccagggaaggggctggagtggattgggagtatctattatagtgggagcacctactacaacccgtccctcaagagtcgagtcaccatatccgtagacacgtccaagaaccagttctccctgaagctgagctctgtgaccgccgcagacacggctgtgtattactgtgcg

SEQ ID NO: 651 - DNA, 299 bp, Homo sapiens
  IGHV4-39*06
cggctgcagctgcaggagtcgggcccaggactggtgaagccttcggagaccctgtccctcacctgcactgtctctggtggctccatcagcagtagtagttactactggggctggatccgccagcccccagggaaggggctggagtggattgggagtatctattatagtgggagcacctactacaacccgtccctcaagagtcgagtcaccatatcagtagacacgtccaagaaccagttccccctgaagctgagctctgtgaccgccgcggacacggccgtgtattactgtgcgagaga

SEQ ID NO: 652 - DNA, 299 bp, Homo sapiens
  IGHV4-39*07
cagctgcagctgcaggagtcgggcccaggactggtgaagccttcggagaccctgtccctcacctgcactgtctctggtggctccatcagcagtagtagttactactggggctggatccgccagcccccagggaaggggctggagtggattgggagtatctattatagtgggagcacctactacaacccgtccctcaagagtcgagtcaccatatcagtagacacgtccaagaaccagttctccctgaagctgagctctgtgaccgccgcggacacggccgtgtattactgtgcgagaga

SEQ ID NO: 653 - DNA, 296 bp, Homo sapiens
  IGHV4-4*01
caggtgcagctgcaggagtcgggcccaggactggtgaagcctccggggaccctgtccctcacctgcgctgtctctggtggctccatcagcagtagtaactggtggagttgggtccgccagcccccagggaaggggctggagtggattggggaaatctatcatagtgggagcaccaactacaacccgtccctcaagagtcgagtcaccatatcagtagacaagtccaagaaccagttctccctgaagctgagctctgtgaccgccgcggacacggccgtgtattgctgtgcgagaga

SEQ ID NO: 654 - DNA, 296 bp, Homo sapiens
  IGHV4-4*02
caggtgcagctgcaggagtcgggcccaggactggtgaagccttcggggaccctgtccctcacctgcgctgtctctggtggctccatcagcagtagtaactggtggagttgggtccgccagcccccagggaaggggctggagtggattggggaaatctatcatagtgggagcaccaactacaacccgtccctcaagagtcgagtcaccatatcagtagacaagtccaagaaccagttctccctgaagctgagctctgtgaccgccgcggacacggccgtgtattactgtgcgagaga

SEQ ID NO: 655 - DNA, 287 bp, Homo sapiens
  IGHV4-4*03
caggtgcagctgcaggagtcgggcccaggactggtgaagcctccggggaccctgtccctcacctgcgctgtctctggtggctccatcagcagtagtaactggtggagttgggtccgccagcccccagggaaggggctggagtggattggggaaatctatcatagtgggagcaccaactacaacccgtccctcaagagtcgagtcaccatatcagtagacaagtccaagaaccagttctccctgaagctgagctctgtgaccgccgcggacacggccgtgtattactg

SEQ ID NO: 656 - DNA, 287 bp, Homo sapiens
  IGHV4-4*04
caggtgcagctgcaggagtcgggcccaggactggtgaagcctccggggaccctgtccctcacctgcgctatctctggtggctccatcagcagtagtaactggtggagttgggtccgccagcccccagggaaggggctggagtggattggggaaatctatcatagtgggagcaccaactacaacccgtccctcaagagtcgagtcaccatatcagtagacaagtccaagaaccagttctccctgaagctgagctctgtgaccgccgcggacacggccgtgtattactg

SEQ ID NO: 657 - DNA, 287 bp, Homo sapiens
  IGHV4-4*05
caggtgcagctgcaggagttgggcccaggactggtgaagcctccggggaccctgtccctcacctgcgctgtctctggtggctccatcagcagtagtaactggtggagttgggtccgccagcccccagggaaggggctggagtggattggggaaatctatcatagtgggagcaccaactacaacccgtccctcaagagtcgagtcaccatatcagtagacaagtccaagaaccagttctccctgaagctgagctctgtgaccgccgcggacacggccgtgtattactg

SEQ ID NO: 658 - DNA, 224 bp, Homo sapiens
  IGHV4-4*06
  modified_base (59)..(61): a, c, t or g
tctggtggctccatcagcagtagtaactggtggagttgggtccgccagcccccagggannnggctggagtggattggggaaatctatcatagtgggagcaccaactacaacccgtccctcaagagtcgagtcaccatgtcagtagacacgtccaagaaccagttctccctgaagctgagctctgtgaccgccgcggacacggccgtgtattactgtgcgagaga

SEQ ID NO: 659 - DNA, 293 bp, Homo sapiens
  IGHV4-4*07
caggtgcagctgcaggagtcgggcccaggactggtgaagccttcggagaccctgtccctcacctgcactgtctctggtggctccatcagtagttactactggagctggatccggcagcccgccgggaagggactggagtggattgggcgtatctataccagtgggagcaccaactacaacccctccctcaagagtcgagtcaccatgtcagtagacacgtccaagaaccagttctccctgaagctgagctctgtgaccgccgcggacacggccgtgtattactgtgcgagaga

SEQ ID NO: 660 - DNA, 293 bp, Homo sapiens
  IGHV4-59*01
caggtgcagctgcaggagtcgggcccaggactggtgaagccttcggagaccctgtccctcacctgcactgtctctggtggctccatcagtagttactactggagctggatccggcagcccccagggaagggactggagtggattgggtatatctattacagtgggagcaccaactacaacccctccctcaagagtcgagtcaccatatcagtagacacgtccaagaaccagttctccctgaagctgagctctgtgaccgctgcggacacggccgtgtattactgtgcgagaga

SEQ ID NO: 661 - DNA, 293 bp, Homo sapiens
  IGHV4-59*02
caggtgcagctgcaggagtcgggcccaggactggtgaagccttcggagaccctgtccctcacctgcactgtctctggtggctccgtcagtagttactactggagctggatccggcagcccccagggaagggactggagtggattgggtatatctattacagtgggagcaccaactacaacccctccctcaagagtcgagtcaccatatcagtagacacgtccaagaaccagttctccctgaagctgagctctgtgaccgctgcggacacggccgtgtattactgtgcgagaga

SEQ ID NO: 662 - DNA, 288 bp, Homo sapiens
  IGHV4-59*03
caggtgcagctgcaggagtcgggcccaggactggtgaagccttcggagaccctgtccctcacctgcactgtctctggtggctccatcagtagttactactggagctggatccggcagcccccagggaagggactggagtggattgggtatatctattacagtgggagcaccaactacaacccctccctcaagagtcgagtcaccatatcagtagacacgtccaagaaccaattctccctgaagctgagctctgtgaccgctgcggacacggccgtgtattactgtgcg

SEQ ID NO: 663 - DNA, 288 bp, Homo sapiens
  IGHV4-59*04
caggtgcagctgcaggagtcgggcccaggactggtgaagccttcggagaccctgtccctcacctgcactgtctctggtggctccatcagtagttactactggagctggatccggcagcccccagggaagggactggagtggattgggtatatctattatagtgggagcacctactacaacccgtccctcaagagtcgagtcaccatgtcagtagacacgtccaagaaccagttctccctgaagctgagctctgtgaccgccgcagacacggctgtgtattactgtgcg

SEQ ID NO: 664 - DNA, 288 bp, Homo sapiens
  IGHV4-59*05
caggtgcagctgcaggagtcgggcccaggactggtgaagccttcggagaccctgtccctcacctgcactgtctctggtggctccatcagtagttactactggagctggatccggcagccgccggggaagggactggagtggattgggcgtatctattatagtgggagcacctactacaacccgtccctcaagagtcgagtcaccatatccgtagacacgtccaagaaccagttctccctgaagctgagctctgtgaccgccgcagacacggctgtgtattactgtgcg

SEQ ID NO: 665 - DNA, 288 bp, Homo sapiens
  IGHV4-59*06
caggtgcagctgcaggagtcgggcccaggactggtgaagccttcggagaccctgtccctcacctgcactgtcactggtggctccatcagtagttactactggagctggatccggcagcccgctgggaagggcctggagtggattgggtacatctattacagtgggagcacctactacaacccgtccctcaagagtcgagttaccatatcagtagacacgtctaagaaccagttctccctgaagctgagctctgtgactgccgcggacacggccgtgtattactgtgcg

SEQ ID NO: 666 - DNA, 291 bp, Homo sapiens
  IGHV4-59*07
caggtgcagctgcaggagtcgggcccaggactggtgaagccttcggacaccctgtccctcacctgcactgtctctggtggctccatcagtagttactactggagctggatccggcagcccccagggaagggactggagtggattgggtatatctattacagtgggagcaccaactacaacccctccctcaagagtcgagtcaccatatcagtagacacgtccaagaaccagttctccctgaagctgagctctgtgaccgctgcggacacggccgtgtattactgtgcgaga

SEQ ID NO: 667 - DNA, 237 bp, Homo sapiens
  IGHV4-59*08
  modified_base (36)..(36): a, c, t or g
  modified_base (214)..(214): a, c, t or g
tccctcacctgcactgtctctggtggctccatcagnagttactactggagctggatccggcagcccccagggaagggactggagtggattgggtatatctattacagtgggagcaccaactacaacccctccctcaagagtcgagtcaccatatcagtagacacgtccaagaaccagttctccctgaagctgagctctgtgaccgccgcagacncggccgtgtattactgtgcgaga

SEQ ID NO: 668 - DNA, 221 bp, Homo sapiens
  IGHV4-59*09
  modified_base (54)..(54): a, c, t or g
  modified_base (56)..(58): a, c, t or g
tctggtggctccatcagtagttactactggagctggatccggcagcccccaggnannngactggagtggattgggtatatctattacagtgggagcaccaactacaacccctccctcaagagtcgagtcaccatatcagtagacacgtccaagaaccagttctccctgaagctgagctctgtgaccgctgcggacacggccgtgtattactgtgcgagagg

SEQ ID NO: 669 - DNA, 293 bp, Homo sapiens
  IGHV4-59*10
caggtgcagctacagcagtggggcgcaggactgttgaagccttcggagaccctgtccctcacctgcgctgtctatggtggctccatcagtagttactactggagctggatccggcagcccgccgggaaggggctggagtggattgggcgtatctataccagtgggagcaccaactacaacccctccctcaagagtcgagtcaccatgtcagtagacacgtccaagaaccagttctccctgaagctgagctctgtgaccgccgcggacacggccgtgtattactgtgcgagata

SEQ ID NO: 670 - DNA, 299 bp, Homo sapiens
  IGHV4-61*01
caggtgcagctgcaggagtcgggcccaggactggtgaagccttcggagaccctgtccctcacctgcactgtctctggtggctccgtcagcagtggtagttactactggagctggatccggcagcccccagggaagggactggagtggattgggtatatctattacagtgggagcaccaactacaacccctccctcaagagtcgagtcaccatatcagtagacacgtccaagaaccagttctccctgaagctgagctctgtgaccgctgcggacacggccgtgtattactgtgcgagaga

SEQ ID NO: 671 - DNA, 299 bp, Homo sapiens
  IGHV4-61*02
caggtgcagctgcaggagtcgggcccaggactggtgaagccttcacagaccctgtccctcacctgcactgtctctggtggctccatcagcagtggtagttactactggagctggatccggcagcccgccgggaagggactggagtggattgggcgtatctataccagtgggagcaccaactacaacccctccctcaagagtcgagtcaccatatcagtagacacgtccaagaaccagttctccctgaagctgagctctgtgaccgccgcagacacggccgtgtattactgtgcgagaga

SEQ ID NO: 672 - DNA, 299 bp, Homo sapiens
  IGHV4-61*03
caggtgcagctgcaggagtcgggcccaggactggtgaagccttcggagaccctgtccctcacctgcactgtctctggtggctccgtcagcagtggtagttactactggagctggatccggcagcccccagggaagggactggagtggattgggtatatctattacagtgggagcaccaactacaacccctccctcaagagtcgagtcaccatatcagtagacacgtccaagaaccacttctccctgaagctgagctctgtgaccgctgcggacacggccgtgtattactgtgcgagaga

SEQ ID NO: 673 - DNA, 287 bp, Homo sapiens
  IGHV4-61*04
caggtgcagctgcaggagtcgggcccaggactggtgaagccttcggagaccctgtccctcacctgcactgtctctggtggctccgtcagcagtggtagttactactggagctggatccggcagcccccagggaagggactggagtggattggatatatctattacagtgggagcaccaactacaacccctccctcaagagtcgagtcaccatatcagtagacacgtccaagaaccagttctccctgaagctgagctctgtgaccgctgacacggccgtgtattactg

SEQ ID NO: 674 - DNA, 297 bp, Homo sapiens
  IGHV4-61*05
cagctgcagctgcaggagtcgggcccaggactggtgaagccttcggagaccctgtccctcacctgcactgtctctggtggctccatcagcagtagtagttactactggggctggatccggcagcccccagggaagggactggagtggattgggtatatctattacagtgggagcaccaactacaacccctccctcaagagtcgagtcaccatatcagtagacaagtccaagaaccagttctccctgaagctgagctctgtgaccgccgcggacacggccgtgtattactgtgcgaga

SEQ ID NO: 675 - DNA, 227 bp, Homo sapiens
  IGHV4-61*06
tctggtggctccgtcagcagtggtagttactactggagctggatccggcagcccccagggaagggactggagtggattgggtatatctattacagtgggagcaccaactacaacccctccctcaagagtcgagtcaccatatcagtagacacgtccaagaaccagttctccctgaagctgagctctgtgaccgccgcggacacggccgtgtattactgtgccagaga

SEQ ID NO: 676 - DNA, 227 bp, Homo sapiens
  IGHV4-61*07
tctggtggctccgtcagcagtggtagttactactggagctggatccggcagcccccagggaagggactggagtggattgggtatatctattacagtgggagcaccaactacaacccctccctcaagagtcgagtcaccatatcagtagacacgtccaagaaccagttctccctgaagctgagctctgtgaccgctgcggacacggccgtgtattactgtgcgagaca

SEQ ID NO: 677 - DNA, 299 bp, Homo sapiens
  IGHV4-61*08
caggtgcagctgcaggagtcgggcccaggactggtgaagccttcggagaccctgtccctcacctgcactgtctctggtggctccgtcagcagtggtggttactactggagctggatccggcagcccccagggaagggactggagtggattgggtatatctattacagtgggagcaccaactacaacccctccctcaagagtcgagtcaccatatcagtagacacgtccaagaaccagttctccctgaagctgagctctgtgaccgctgcggacacggccgtgtattactgtgcgagaga

SEQ ID NO: 678 - DNA, 294 bp, Homo sapiens
  IGHV4-b*01
caggtgcagctgcaggagtcgggcccaggactggtgaagccttcggagaccctgtccctcacctgcgctgtctctggttactccatcagcagtggttactactggggctggatccggcagcccccagggaaggggctggagtggattgggagtatctatcatagtgggagcacctactacaacccgtccctcaagagtcgagtcaccatatcagtagacacgtccaagaaccagttctccctgaagctgagctctgtgaccgccgcagacacggccgtgtattactgtgcgaga

SEQ ID NO: 679 - DNA, 294 bp, Homo sapiens
  IGHV4-b*02
caggtgcagctgcaggagtcgggcccaggactggtgaagccttcggagaccctgtccctcacctgcactgtctctggttactccatcagcagtggttactactggggctggatccggcagcccccagggaaggggctggagtggattgggagtatctatcatagtgggagcacctactacaacccgtccctcaagagtcgagtcaccatatcagtagacacgtccaagaaccagttctccctgaagctgagctctgtgaccgccgcagacacggccgtgtattactgtgcgaga

SEQ ID NO: 680 - DNA, 296 bp, Homo sapiens
  IGHV5-51*01
gaggtgcagctggtgcagtctggagcagaggtgaaaaagcccggggagtctctgaagatctcctgtaagggttctggatacagctttaccagctactggatcggctgggtgcgccagatgcccgggaaaggcctggagtggatggggatcatctatcctggtgactctgataccagatacagcccgtccttccaaggccaggtcaccatctcagccgacaagtccatcagcaccgcctacctgcagtggagcagcctgaaggcctcggacaccgccatgtattactgtgcgagaca

SEQ ID NO: 681 - DNA, 296 bp, Homo sapiens
  IGHV5-51*02
gaggtgcagctggtgcagtctggagcagaggtgaaaaagcccggggagtctctgaagatctcctgtaagggttctggatacagctttaccagctactggaccggctgggtgcgccagatgcccgggaaaggcttggagtggatggggatcatctatcctggtgactctgataccagatacagcccgtccttccaaggccaggtcaccatctcagccgacaagtccatcagcaccgcctacctgcagtggagcagcctgaaggcctcggacaccgccatgtattactgtgcgagaca

SEQ ID NO: 682 - DNA, 294 bp, Homo sapiens
  IGHV5-51*03
gaggtgcagctggtgcagtctggagcagaggtgaaaaagccgggggagtctctgaagatctcctgtaagggttctggatacagctttaccagctactggatcggctgggtgcgccagatgcccgggaaaggcctggagtggatggggatcatctatcctggtgactctgataccagatacagcccgtccttccaaggccaggtcaccatctcagccgacaagtccatcagcaccgcctacctgcagtggagcagcctgaaggcctcggacaccgccatgtattactgtgcgaga

SEQ ID NO: 683 - DNA, 294 bp, Homo sapiens
  IGHV5-51*04
gaggtgcagctggtgcagtctggagcagaggtgaaaaagccgggggagtctctgaagatctcctgtaagggttctggatacagctttaccagctactggatcggctgggtgcgccagatgcccgggaaaggcctggagtggatggggatcatctatcctggtgactctgataccagatacagcccgtccttccaaggccaggtcaccatctcagccgacaagcccatcagcaccgcctacctgcagtggagcagcctgaaggcctcggacaccgccatgtattactgtgcgaga

SEQ ID NO: 684 - DNA, 245 bp, Homo sapiens
  IGHV5-51*05
aaaagcccggggagtctctgaagatctcctgtaagggttctggatacagctttaccagctactggatcggctgggtgcgccagatgcccaggaaaggcctggagtggatggggatcatctatcctggtgactctgataccagatacagcccgtccttccaaggccaggtcaccatctcagccgacaagtccatcagcaccgcctacctgcagtggagcagcctgaaggcctcggacaccgccatg

SEQ ID NO: 685 - DNA, 294 bp, Homo sapiens
  IGHV5-a*01
gaagtgcagctggtgcagtctggagcagaggtgaaaaagcccggggagtctctgaggatctcctgtaagggttctggatacagctttaccagctactggatcagctgggtgcgccagatgcccgggaaaggcctggagtggatggggaggattgatcctagtgactcttataccaactacagcccgtccttccaaggccacgtcaccatctcagctgacaagtccatcagcactgcctacctgcagtggagcagcctgaaggcctcggacaccgccatgtattactgtgcgaga

SEQ ID NO: 686 - DNA, 294 bp, Homo sapiens
  IGHV5-a*03
gaagtgcagctggtgcagtccggagcagaggtgaaaaagcccggggagtctctgaggatctcctgtaagggttctggatacagctttaccagctactggatcagctgggtgcgccagatgcccgggaaaggcctggagtggatggggaggattgatcctagtgactcttataccaactacagcccgtccttccaaggccacgtcaccatctcagctgacaagtccatcagcactgcctacctgcagtggagcagcctgaaggcctcggacaccgccatgtattactgtgcgaga

SEQ ID NO: 687 - DNA, 294 bp, Homo sapiens
  IGHV5-a*04
gaagtgcagctggtgcagtctggagcagaggtgaaaaagcccggggagtctctgaggatctcctgtaagggttctggatacagctttaccagctactggatcagctgggtgcgccagatgcccgggaaaggcctggagtggatggggaggattgatcctagtgactcttataccaactacagcccgtccttccaaggccaggtcaccatctcagctgacaagtccatcagcactgcctacctgcagtggagcagcctgaaggcctcggacaccgccatgtattactgtgcgaga

SEQ ID NO: 688 - DNA, 305 bp, Homo sapiens
  IGHV6-1*01
caggtacagctgcagcagtcaggtccaggactggtgaagccctcgcagaccctctcactcacctgtgccatctccggggacagtgtctctagcaacagtgctgcttggaactggatcaggcagtccccatcgagaggccttgagtggctgggaaggacatactacaggtccaagtggtataatgattatgcagtatctgtgaaaagtcgaataaccatcaacccagacacatccaagaaccagttctccctgcagctgaactctgtgactcccgaggacacggctgtgtattactgtgcaagaga

SEQ ID NO: 689 - DNA, 305 bp, Homo sapiens
  IGHV6-1*02
caggtacagctgcagcagtcaggtccgggactggtgaagccctcgcagaccctctcactcacctgtgccatctccggggacagtgtctctagcaacagtgctgcttggaactggatcaggcagtccccatcgagaggccttgagtggctgggaaggacatactacaggtccaagtggtataatgattatgcagtatctgtgaaaagtcgaataaccatcaacccagacacatccaagaaccagttctccctgcagctgaactctgtgactcccgaggacacggctgtgtattactgtgcaagaga

SEQ ID NO: 690 - DNA, 31 bp, Homo sapiens
  IGHD2-15*01
aggatattgtagtggtggtagctgctactcc

SEQ ID NO: 691 - DNA, 31 bp, Homo sapiens
  IGHD2-2*01
aggatattgtagtagtaccagctgctatgcc

SEQ ID NO: 692 - DNA, 31 bp, Homo sapiens
  IGHD2-2*02
aggatattgtagtagtaccagctgctatacc

SEQ ID NO: 693 - DNA, 31 bp, Homo sapiens
  IGHD2-2*03
tggatattgtagtagtaccagctgctatgcc

SEQ ID NO: 694 - DNA, 28 bp, Homo sapiens
  IGHD2-21*01
agcatattgtggtggtgattgctattcc

SEQ ID NO: 695 - DNA, 28 bp, Homo sapiens
  IGHD2-21*02
agcatattgtggtggtgactgctattcc

SEQ ID NO: 696 - DNA, 31 bp, Homo sapiens
  IGHD2-8*01
aggatattgtactaatggtgtatgctatacc

SEQ ID NO: 697 - DNA, 31 bp, Homo sapiens
  IGHD2-8*02
aggatattgtactggtggtgtatgctatacc

SEQ ID NO: 698 - DNA, 31 bp, Homo sapiens
  IGHD3-10*01
gtattactatggttcggggagttattataac

SEQ ID NO: 699 - DNA, 30 bp, Homo sapiens
  IGHD3-10*02
gtattactatgttcggggagttattataac

SEQ ID NO: 700 - DNA, 37 bp, Homo sapiens
  IGHD3-16*01
gtattatgattacgtttgggggagttatgcttatacc

SEQ ID NO: 701 - DNA, 37 bp, Homo sapiens
  IGHD3-16*02
gtattatgattacgtttgggggagttatcgttatacc

SEQ ID NO: 702 - DNA, 31 bp, Homo sapiens
  IGHD3-22*01
gtattactatgatagtagtggttattactac

SEQ ID NO: 703 - DNA, 31 bp, Homo sapiens
  IGHD3-3*01
gtattacgatttttggagtggttattatacc

SEQ ID NO: 704 - DNA, 31 bp, Homo sapiens
  IGHD3-3*02
gtattagcatttttggagtggttattatacc

SEQ ID NO: 705 - DNA, 31 bp, Homo sapiens
  IGHD3-9*01
gtattacgatattttgactggttattataac

SEQ ID NO: 706 - DNA, 16 bp, Homo sapiens
  IGHD4-11*01
tgactacagtaactac

SEQ ID NO: 707 - DNA, 16 bp, Homo sapiens
  IGHD4-17*01
tgactacggtgactac

SEQ ID NO: 708 - DNA, 19 bp, Homo sapiens
  IGHD4-23*01
tgactacggtggtaactcc

SEQ ID NO: 709 - DNA, 16 bp, Homo sapiens
  IGHD4-4*01
tgactacagtaactac

SEQ ID NO: 710 - DNA, 23 bp, Homo sapiens
  IGHD5-12*01
gtggatatagtggctacgattac

SEQ ID NO: 711 - DNA, 20 bp, Homo sapiens
  IGHD5-18*01
gtggatacagctatggttac

SEQ ID NO: 712 - DNA, 20 bp, Homo sapiens
  IGHD5-24*01
gtagagatggctacaattac

SEQ ID NO: 713 - DNA, 20 bp, Homo sapiens
  IGHD5-5*01
gtggatacagctatggttac

SEQ ID NO: 714 - DNA, 21 bp, Homo sapiens
  IGHD6-13*01
gggtatagcagcagctggtac

SEQ ID NO: 715 - DNA, 21 bp, Homo sapiens
  IGHD6-19*01
gggtatagcagtggctggtac

SEQ ID NO: 716 - DNA, 18 bp, Homo sapiens
  IGHD6-25*01
gggtatagcagcggctac

SEQ ID NO: 717 - DNA, 18 bp, Homo sapiens
  IGHD6-6*01
gagtatagcagctcgtcc

SEQ ID NO: 718 - DNA, 11 bp, Homo sapiens
  IGHD7-27*01
ctaactgggga

SEQ ID NO: 719 - DNA, 52 bp, Homo sapiens
  IGHJ1*01
gctgaatacttccagcactggggccagggcaccctggtcaccgtctcctcag

SEQ ID NO: 720 - DNA, 53 bp, Homo sapiens
  IGHJ2*01
ctactggtacttcgatctctggggccgtggcaccctggtcactgtctcctcag

SEQ ID NO: 721 - DNA, 50 bp, Homo sapiens
  IGHJ3*01
tgatgcttttgatgtctggggccaagggacaatggtcaccgtctcttcag

SEQ ID NO: 722 - DNA, 48 bp, Homo sapiens
  IGHJ4*01
actactttgactactggggccaaggaaccctggtcaccgtctcctcag

SEQ ID NO: 723 - DNA, 48 bp, Homo sapiens
  IGHJ4*02
actactttgactactggggccagggaaccctggtcaccgtctcctcag

SEQ ID NO: 724 - DNA, 48 bp, Homo sapiens
  IGHJ4*03
gctactttgactactggggccaagggaccctggtcaccgtctcctcag

SEQ ID NO: 725 - DNA, 63 bp, Homo sapiens
  IGHJ6*01
attactactactactacggtatggacgtctgggggcaagggaccacggtcaccgtctcctcag

SEQ ID NO: 726 - DNA, 62 bp, Homo sapiens
  IGHJ6*02
attactactactactacggtatggacgtctggggccaagggaccacggtcaccgtctcctca

SEQ ID NO: 727 - DNA, 62 bp, Homo sapiens
  IGHJ6*03
attactactactactactacatggacgtctggggcaaagggaccacggtcaccgtctcctca

SEQ ID NO: 728 - DNA, 63 bp, Homo sapiens
  IGHJ6*04
attactactactactacggtatggacgtctggggcaaagggaccacggtcaccgtctcctcag

SEQ ID NO: 729 - DNA, 287 bp, Homo sapiens
  IGKV1-12*01
gacatccagatgacccagtctccatcttccgtgtctgcatctgtaggagacagagtcaccatcacttgtcgggcgagtcagggtattagcagctggttagcctggtatcagcagaaaccagggaaagcccctaagctcctgatctatgctgcatccagtttgcaaagtggggtcccatcaaggttcagcggcagtggatctgggacagatttcactctcaccatcagcagcctgcagcctgaagattttgcaacttactattgtcaacaggctaacagtttccctcc

SEQ ID NO: 730 - DNA, 287 bp, Homo sapiens
  IGKV1-12*02
gacatccagatgacccagtctccatcttccgtgtctgcatctgtaggagacagagtcaccatcacttgtcgggcgagtcagggtattagcagctggttagcctggtatcagcagaaaccagggaaagcccctaagctcctgatctatgctgcatccagtttgcaaagtggggtcccatcaaggttcagcggcagtggatctgggacagatttcactctcaccatcagcagcctgcagcctgaagattttgcaacttactattgtcaacaggctaacagtttcccttc

SEQ ID NO: 731 - DNA, 287 bp, Homo sapiens
  IGKV1-13*02
gccatccagttgacccagtctccatcctccctgtctgcatctgtaggagacagagtcaccatcacttgccgggcaagtcagggcattagcagtgctttagcctggtatcagcagaaaccagggaaagctcctaagctcctgatctatgatgcctccagtttggaaagtggggtcccatcaaggttcagcggcagtggatctgggacagatttcactctcaccatcagcagcctgcagcctgaagattttgcaacttattactgtcaacagtttaatagttaccctca

SEQ ID NO: 732 - DNA, 287 bp, Homo sapiens
  IGKV1-16*01
gacatccagatgacccagtctccatcctcactgtctgcatctgtaggagacagagtcaccatcacttgtcgggcgagtcagggcattagcaattatttagcctggtttcagcagaaaccagggaaagcccctaagtccctgatctatgctgcatccagtttgcaaagtggggtcccatcaaggttcagcggcagtggatctgggacagatttcactctcaccatcagcagcctgcagcctgaagattttgcaacttattactgccaacagtataatagttaccctcc

SEQ ID NO: 733 - DNA, 287 bp, Homo sapiens
  IGKV1-17*01
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatgctgcatccagtttgcaaagtggggtcccatcaaggttcagcggcagtggatctgggacagaattcactctcacaatcagcagcctgcagcctgaagattttgcaacttattactgtctacagcataatagttaccctcc

SEQ ID NO: 734 - DNA, 287 bp, Homo sapiens
  IGKV1-17*02
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatgctgcatccagtttgcaaagtggggtcccatcaaggttcagcggcagtggatctgggacagaattcactctcacaatcagcaacctgcagcctgaagattttgcaacttattactgtctacagcataatagttaccctcc

SEQ ID NO: 735 - DNA, 287 bp, Homo sapiens
  IGKV1-27*01
gacatccagatgacccagtctccatcctccctgtctgcatctgtaggagacagagtcaccatcacttgccgggcgagtcagggcattagcaattatttagcctggtatcagcagaaaccagggaaagttcctaagctcctgatctatgctgcatccactttgcaatcaggggtcccatctcggttcagtggcagtggatctgggacagatttcactctcaccatcagcagcctgcagcctgaagatgttgcaacttattactgtcaaaagtataacagtgcccctcc

SEQ ID NO: 736 - DNA, 287 bp, Homo sapiens
  IGKV1-33*01
gacatccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacagtatgataatctccctcc

SEQ ID NO: 737 - DNA, 287 bp, Homo sapiens
  IGKV1-37*01
gacatccagttgacccagtctccatcctccctgtctgcatctgtaggagacagagtcaccatcacttgccgggtgagtcagggcattagcagttatttaaattggtatcggcagaaaccagggaaagttcctaagctcctgatctatagtgcatccaatttgcaatctggagtcccatctcggttcagtggcagtggatctgggacagatttcactctcactatcagcagcctgcagcctgaagatgttgcaacttattacggtcaacggacttacaatgcccctcc

SEQ ID NO: 738 - DNA, 287 bp, Homo sapiens
  IGKV1-39*01
gacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctcc

SEQ ID NO: 739 - DNA, 287 bp, Homo sapiens
  IGKV1-39*02
gacatccagatgacccagtctccatccttcctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttattactgtcagtgtggttacagtacacctcc

SEQ ID NO: 740 - DNA, 287 bp, Homo sapiens
  IGKV1-5*01
gacatccagatgacccagtctccttccaccctgtctgcatctgtaggagacagagtcaccatcacttgccgggccagtcagagtattagtagctggttggcctggtatcagcagaaaccagggaaagcccctaagctcctgatctatgatgcctccagtttggaaagtggggtcccatcaaggttcagcggcagtggatctgggacagaattcactctcaccatcagcagcctgcagcctgatgattttgcaacttattactgccaacagtataatagttattctcc

SEQ ID NO: 741 - DNA, 287 bp, Homo sapiens
  IGKV1-5*02
gacatccagatgacccagtctccttccaccctgtctgcatctgtaggagacagagtcaccatcatttgccgggccagtcagagtattagtagctggttggcctggtatcagcagaaaccagggaaagcccctaagctcctgatctatgatgcctccagtttggaaagtggggtcccatcaaggttcagcggcagtggatctgggacagaattcactctcaccatcagcagcctgcagcctgatgattttgcaacttattactgccaacagtataatagttattctcc

SEQ ID NO: 742 - DNA, 287 bp, Homo sapiens
  IGKV1-5*03
gacatccagatgacccagtctccttccaccctgtctgcatctgtaggagacagagtcaccatcacttgccgggccagtcagagtattagtagctggttggcctggtatcagcagaaaccagggaaagcccctaagctcctgatctataaggcgtctagtttagaaagtggggtcccatcaaggttcagcggcagtggatctgggacagaattcactctcaccatcagcagcctgcagcctgatgattttgcaacttattactgccaacagtataatagttattctcc

SEQ ID NO: 743 - DNA, 287 bp, Homo sapiens
  IGKV1-6*01
gccatccagatgacccagtctccatcctccctgtctgcatctgtaggagacagagtcaccatcacttgccgggcaagtcagggcattagaaatgatttaggctggtatcagcagaaaccagggaaagcccctaagctcctgatctatgctgcatccagtttacaaagtggggtcccatcaaggttcagcggcagtggatctggcacagatttcactctcaccatcagcagcctgcagcctgaagattttgcaacttattactgtctacaagattacaattaccctcc

SEQ ID NO: 744 - DNA, 287 bp, Homo sapiens
  IGKV1-8*01
gccatccggatgacccagtctccatcctcattctctgcatctacaggagacagagtcaccatcacttgtcgggcgagtcagggtattagcagttatttagcctggtatcagcaaaaaccagggaaagcccctaagctcctgatctatgctgcatccactttgcaaagtggggtcccatcaaggttcagcggcagtggatctgggacagatttcactctcaccatcagctgcctgcagtctgaagattttgcaacttattactgtcaacagtattatagttaccctcc

SEQ ID NO: 745 - DNA, 287 bp, Homo sapiens
  IGKV1-9*01
gacatccagttgacccagtctccatccttcctgtctgcatctgtaggagacagagtcaccatcacttgccgggccagtcagggcattagcagttatttagcctggtatcagcaaaaaccagggaaagcccctaagctcctgatctatgctgcatccactttgcaaagtggggtcccatcaaggttcagcggcagtggatctgggacagaattcactctcacaatcagcagcctgcagcctgaagattttgcaacttattactgtcaacagcttaatagttaccctcc

SEQ ID NO: 746 - DNA, 287 bp, Homo sapiens
  IGKV1-NL1*01
gacatccagatgacccagtctccatcctccctgtctgcatctgtaggagacagagtcaccatcacttgccgggcgagtcagggcattagcaattctttagcctggtatcagcagaaaccagggaaagcccctaagctcctgctctatgctgcatccagattggaaagtggggtcccatccaggttcagtggcagtggatctgggacggattacactctcaccatcagcagcctgcagcctgaagattttgcaacttattactgtcaacagtattatagtacccctcc

SEQ ID NO: 747 - DNA, 287 bp, Homo sapiens
  IGKV1/OR2-0*01
gacatccagatgacccagtctccatcctccctgtctgcatctgtaggagacagagtcaccatcacttgccgggcgagtcagggcattagcaataatttaaattggtatcagcagaaaccagggaaaactcctaagctcctgatctatgctgcacccagtctgcaaagtgggattccctctcggttcagtgacagtggatctggggcagattacactctcaccatccgcagcctgcagcctgaagattttgcaacttattactgtcaacagagtgacagtacccctcc

SEQ ID NO: 748 - DNA, 287 bp, Homo sapiens
  IGKV1/OR2-108*01
gacatccaggtgacccagtctccatcttccctgtctgcgtctgtaggagacagagtcaccatcacctgccgggcaagtcagggcattagcaatgggttatcctggtatcagcagaaaccagggcaagcccctacgctcctgatctatgctgcatccagtttgcagtcgggggtcccatctcggttcagtggcagtggatctgggacagatttcactctcaccatcagcagcctgcagcctgaagatgttgcaacttattactgtctacaggattatactaccccatt

SEQ ID NO: 749 - DNA, 287 bp, Homo sapiens
  IGKV1D-12*01
gacatccagatgacccagtctccatcttctgtgtctgcatctgtaggagacagagtcaccatcacttgtcgggcgagtcagggtattagcagctggttagcctggtatcagcagaaaccagggaaagcccctaagctcctgatctatgctgcatccagtttgcaaagtggggtcccatcaaggttcagcggcagtggatctgggacagatttcactctcactatcagcagcctgcagcctgaagattttgcaacttactattgtcaacaggctaacagtttccctcc

SEQ ID NO: 750 - DNA, 287 bp, Homo sapiens; identical to SEQ ID NO: 730
  IGKV1D-12*02

SEQ ID NO: 751 - DNA, 287 bp, Homo sapiens
  IGKV1D-13*01
gccatccagttgacccagtctccatcctccctgtctgcatctgtaggagacagagtcaccatcacttgccgggcaagtcagggcattagcagtgctttagcctggtatcagcagaaaccagggaaagctcctaagctcctgatctatgatgcctccagtttggaaagtggggtcccatcaaggttcagcggcagtggatctgggacagatttcactctcaccatcagcagcctgcagcctgaagattttgcaacttattactgtcaacagtttaataattaccctca

SEQ ID NO: 752 - DNA, 287 bp, Homo sapiens
  IGKV1D-16*01
gacatccagatgacccagtctccatcctcactgtctgcatctgtaggagacagagtcaccatcacttgtcgggcgagtcagggtattagcagctggttagcctggtatcagcagaaaccagagaaagcccctaagtccctgatctatgctgcatccagtttgcaaagtggggtcccatcaaggttcagcggcagtggatctgggacagatttcactctcaccatcagcagcctgcagcctgaagattttgcaacttattactgccaacagtataatagttaccctcc

SEQ ID NO: 753 - DNA, 287 bp, Homo sapiens
  IGKV1D-16*02
gacatccagatgacccagtctccatcctcactgtctgcatctgtaggagacagagtcaccatcacttgtcgggcgaggcagggtattagcagctggttagcctggtatcagcagaaaccagagaaagcccctaagtccctgatctatgctgcatccagtttgcaaagtggggtcccatcaaggttcagcggcagtggatctgggacagatttcactctcaccatcagcagcctgcagcctgaagattttgcaacttattactgccaacagtataatagttaccctcc

SEQ ID NO: 754 - DNA, 287 bp, Homo sapiens
  IGKV1D-17*01
aacatccagatgacccagtctccatctgccatgtctgcatctgtaggagacagagtcaccatcacttgtcgggcgaggcagggcattagcaattatttagcctggtttcagcagaaaccagggaaagtccctaagcacctgatctatgctgcatccagtttgcaaagtggggtcccatcaaggttcagcggcagtggatctgggacagaattcactctcacaatcagcagcctgcagcctgaagattttgcaacttattactgtctacagcataatagttaccctcc

SEQ ID NO: 755 - DNA, 287 bp, Homo sapiens; identical to SEQ ID NO: 736
  IGKV1D-33*01

SEQ ID NO: 756 - DNA, 287 bp, Homo sapiens; identical to SEQ ID NO: 737
  IGKV1D-37*01

SEQ ID NO: 757 - DNA, 287 bp, Homo sapiens; identical to SEQ ID NO: 738
  IGKV1D-39*01

SEQ ID NO: 758 - DNA, 287 bp, Homo sapiens
  IGKV1D-42*01
gacatccagatgatccagtctccatctttcctgtctgcatctgtaggagacagagtcagtatcatttgctgggcaagtgagggcattagcagtaatttagcctggtatctgcagaaaccagggaaatcccctaagctcttcctctatgatgcaaaagatttgcaccctggggtctcatcgaggttcagtggcaggggatctgggacggatttcactctcaccatcatcagcctgaagcctgaagattttgcagcttattactgtaaacaggacttcagttaccctcc

SEQ ID NO: 759 - DNA, 287 bp, Homo sapiens
  IGKV1D-43*01
gccatccggatgacccagtctccattctccctgtctgcatctgtaggagacagagtcaccatcacttgctgggccagtcagggcattagcagttatttagcctggtatcagcaaaaaccagcaaaagcccctaagctcttcatctattatgcatccagtttgcaaagtggggtcccatcaaggttcagcggcagtggatctgggacggattacactctcaccatcagcagcctgcagcctgaagattttgcaacttattactgtcaacagtattatagtacccctcc

SEQ ID NO: 760 - DNA, 287 bp, Homo sapiens
  IGKV1D-8*01
gtcatctggatgacccagtctccatccttactctctgcatctacaggagacagagtcaccatcagttgtcggatgagtcagggcattagcagttatttagcctggtatcagcaaaaaccagggaaagcccctgagctcctgatctatgctgcatccactttgcaaagtggggtcccatcaaggttcagtggcagtggatctgggacagatttcactctcaccatcagttgcctgcagtctgaagattttgcaacttattactgtcaacagtattatagtttccctcc

SEQ ID NO: 761 - DNA, 302 bp, Homo sapiens
  IGKV2-24*01
gatattgtgatgacccagactccactctcctcacctgtcacccttggacagccggcctccatctcctgcaggtctagtcaaagcctcgtacacagtgatggaaacacctacttgagttggcttcagcagaggccaggccagcctccaagactcctaatttataagatttctaaccggttctctggggtcccagacagattcagtggcagtggggcagggacagatttcacactgaaaatcagcagggtggaagctgaggatgtcggggtttattactgcatgcaagctacacaatttcctca

SEQ ID NO: 762 - DNA, 302 bp, Homo sapiens
  IGKV2-28*01
gatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactcctcc

SEQ ID NO: 763 - DNA, 302 bp, Homo sapiens
  IGKV2-29*02
gatattgtgatgacccagactccactctctctgtccgtcacccctggacagccggcctccatctcctgcaagtctagtcagagcctcctgcatagtgatggaaagacctatttgtattggtacctgcagaagccaggccagtctccacagctcctaatctatgaagtttccagccggttctctggagtgccagataggttcagtggcagcgggtcagggacagatttcacactgaaaatcagccgggtggaggctgaggatgttggggtttattactgcatgcaaggtatacaccttcctcc

SEQ ID NO: 764 - DNA, 302 bp, Homo sapiens
  IGKV2-29*03
gatattgtgatgacccagactccactctctctgtccgtcacccctggacagccggcctccatctcctgcaagtctagtcagagcctcctgcatagtgatggaaagacctatttgtattggtacctgcagaagccaggccagtctccacagctcctgatctatgaagtttccagccggttctctggagtgccagataggttcagtggcagcgggtcagggacagatttcacactgaaaatcagccgggtggaggctgaggatgttggggtttattactgcatgcaaggtatacaccttcctcc

SEQ ID NO: 765 - DNA, 302 bp, Homo sapiens
  IGKV2-30*01
gatgttgtgatgactcagtctccactctccctgcccgtcacccttggacagccggcctccatctcctgcaggtctagtcaaagcctcgtatacagtgatggaaacacctacttgaattggtttcagcagaggccaggccaatctccaaggcgcctaatttataaggtttctaaccgggactctggggtcccagacagattcagcggcagtgggtcaggcactgatttcacactgaaaatcagcagggtggaggctgaggatgttggggtttattactgcatgcaaggtacacactggcctcc

SEQ ID NO: 766 - DNA, 305 bp, Homo sapiens
  IGKV2-40*01
gatattgtgatgacccagactccactctccctgcccgtcacccctggagagccggcctccatctcctgcaggtctagtcagagcctcttggatagtgatgatggaaacacctatttggactggtacctgcagaagccagggcagtctccacagctcctgatctatacgctttcctatcgggcctctggagtcccagacaggttcagtggcagtgggtcaggcactgatttcacactgaaaatcagcagggtggaggctgaggatgttggagtttattactgcatgcaacgtatagagtttccttc

SEQ ID NO: 767 - DNA, 251 bp, Homo sapiens
  IGKV2-40*02
gcctccatctcctgcaggtctagtcagagcctcttggatagtgatgatggaaacacctatttggattgttacctgcagaagccagggcagtctccacagctcctgatctatacgctttcctatcgggcctctggagtcccagacaggttcagtgacagtgggtcaggcactgatttcacactgaaaatcagcagggtggaggctgaggatgttggagtttattactgcatgcaacgtatagagtttccttc

SEQ ID NO: 768 - DNA, 302 bp, Homo sapiens
  IGKV2D-24*01
gatattgtgatgacccagactccactctcctcgcctgtcacccttggacagccggcctccatctccttcaggtctagtcaaagcctcgtacacagtgatggaaacacctacttgagttggcttcagcagaggccaggccagcctccaagactcctaatttataaggtttctaaccggttctctggggtcccagacagattcagtggcagtggggcagggacagatttcacactgaaaatcagcagggtggaagctgaggatgtcggggtttattactgcacgcaagctacacaatttcctca

SEQ ID NO: 769 - DNA, 302 bp, Homo sapiens
  IGKV2D-26*01
gagattgtgatgacccagactccactctccttgtctatcacccctggagagcaggcctccatctcctgcaggtctagtcagagcctcctgcatagtgatggatacacctatttgtattggtttctgcagaaagccaggccagtctccacactcctgatctatgaagtttccaaccggttctctggagtgccagataggttcagtggcagcgggtcagggacagatttcacactgaaaatcagccgggtggaggctgaggattttggagtttattactgcatgcaagatgcacaagatcctcc

SEQ ID NO: 770 - DNA, 300 bp, Homo sapiens
  IGKV2D-26*02
gagattgtgatgacccagactccactctccttgtctatcacccctggagagcaggcctccatgtcctgcaggtctagtcagagcctcctgcatagtgatggatacacctatttgtattggtttctgcagaaagccaggccagtctccacgctcctgatctgtgaagtttccaaccggttctctggagtgccagataggttcagtggcagcgggtcagggacagatttcacactgaaaatcagccgggtggaggctgaggattttggagtttattactgcatgcaagatgcacaagatcct

SEQ ID NO: 771 - DNA, 302 bp, Homo sapiens; identical to SEQ ID NO: 762
  IGKV2D-28*01

SEQ ID NO: 772 - DNA, 302 bp, Homo sapiens
  IGKV2D-29*01
gatattgtgatgacccagactccactctctctgtccgtcacccctggacagccggcctccatctcctgcaagtctagtcagagcctcctgcatagtgatggaaagacctatttgtattggtacctgcagaagccaggccagcctccacagctcctgatctatgaagtttccaaccggttctctggagtgccagataggttcagtggcagcgggtcagggacagatttcacactgaaaatcagccgggtggaggctgaggatgttggggtttattactgcatgcaaagtatacagcttcctcc

SEQ ID NO: 773 - DNA, 302 bp, Homo sapiens
  IGKV2D-29*02
gatattgtgatgacccagactccactctctctgtccgtcacccctggacagccggcctccatctcctgcaagtctagtcagagcctcctgcatagtgatggaaagacctatttgtattggtacctgcagaagccaggccagtctccacagctcctgatctatgaagtttccaaccggttctctggagtgccagataggttcagtggcagcgggtcagggacagatttcacactgaaaatcagccgggtggaggctgaggatgttggggtttattactgcatgcaaagtatacagcttcctcc

SEQ ID NO: 774 - DNA, 302 bp, Homo sapiens
  IGKV2D-30*01
gatgttgtgatgactcagtctccactctccctgcccgtcacccttggacagccggcctccatctcctgcaggtctagtcaaagcctcgtatacagtgatggaaacacctacttgaattggtttcagcagaggccaggccaatctccaaggcgcctaatttataaggtttctaactgggactctggggtcccagacagattcagcggcagtgggtcaggcactgatttcacactgaaaatcagcagggtggaggctgaggatgttggggtttattactgcatgcaaggtacacactggcctcc

SEQ ID NO: 775 - DNA, 305 bp, Homo sapiens; identical to SEQ ID NO: 766
  IGKV2D-40*01

SEQ ID NO: 776 - DNA, 287 bp, Homo sapiens
  IGKV3-11*01
gaaattgtgttgacacagtctccagccaccctgtctttgtctccaggggaaagagccaccctctcctgcagggccagtcagagtgttagcagctacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcaactggcctcc

SEQ ID NO: 777 - DNA, 287 bp, Homo sapiens
  IGKV3-11*02
gaaattgtgttgacacagtctccagccaccctgtctttgtctccaggggaaagagccaccctctcctgcagggccagtcagagtgttagcagctacttagcctggtaccaacagaaacctggccaggctcccaggctcctcatctatgatgcatccaacagggccactggcatcccagccaggttcagtggcagtgggtctgggagagacttcactctcaccatcagcagcctagagcctgaagattttgcagtttattactgtcagcagcgtagcaactggcctcc

SEQ ID NO: 778 - DNA, 287 bp, Homo sapiens
  IGKV3-15*01
gaaatagtgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtataataactggcctcc

SEQ ID NO: 779 - DNA, 290 bp, Homo sapiens
  IGKV3-20*01
gaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacctcc

SEQ ID NO: 780 - DNA, 271 bp, Homo sapiens
  IGKV3-20*02
gaaattgtgttgacacagtctccagccaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagcaaggttcagtggcagtgggtctgggacagacttcactctcaccatcagcagactggagcctgaagattttgcagtttattactgtcagc

SEQ ID NO: 781 - DNA, 290 bp, Homo sapiens
  IGKV3-7*01
gaaattgtaatgacacagtctccacccaccctgtctttgtctccaggggaaagagtcaccctctcctgcagggccagtcagagtgttagcagcagctacttaacctggtatcagcagaaacctggccaggcgcccaggctcctcatctatggtgcatccaccagggccactagcatcccagccaggttcagtggcagtgggtctgggacagacttcactctcaccatcagcagcctgcagcctgaagattttgcagtttattactgtcagcaggatcataacttacctcc

SEQ ID NO: 782 - DNA, 290 bp, Homo sapiens
  IGKV3-7*02
gaaattgtaatgacacagtctccacccaccctgtctttgtctccaggggaaagagtcaccctctcctgcagggccagtcagagtgttagcagcagctacttatcctggtaccagcagaaacctgggcaggctcccaggctcctcatctatggtgcatccaccagggccactggcatcccagccaggttcagtggcagtgggtctgggacagacttcactctcaccatcagcagcctgcagcctgaagattttgcagtttattactgtcagcaggattataacttacctcc

SEQ ID NO: 783 - DNA, 290 bp, Homo sapiens
  IGKV3-7*03
gaaattgtaatgacacagtctccacccaccctgtctttgtctccaggggaaagagtcaccctctcctgcagggccagtcagagtgttagcagcagctacttaacctggtatcagcagaaacctggccaggcgcccaggctcctcatctatggtgcatccaccagggccactagcatcccagccaggttcagtggcagtgggtctgggagagacttcactctcaccatcagcagcctgcagcctgaagattttgcagtttattactgtcagcaggatcataacttacctcc

SEQ ID NO: 784 - DNA, 268 bp, Homo sapiens
  IGKV3-NL1*01
gaaattgtgttgacacagtctccagccaccctgtctttgtctccaggggaaagagccaccctctcctgcagggccagtcagagtgttagcagctacttagcctggtaccaacagaaacctggccaggctcccaggctcctcatctatggtgcatccaccagggccactggcatcccagccaggttcagtggcagtgggtctgggacagagttcactctcaccatcagcagcctgcagtctgaagattttgcagtttattactgtcagc

SEQ ID NO: 785 - DNA, 268 bp, Homo sapiens
  IGKV3-NL2*01
gaaattgtgttgacacagtctccagccaccctgtctttgtctccaggggaaagagccaccctctcctgcagggccagtcagggtgttagcagctacttagcctggtaccagcagaaacctggccaggctcccaggctcctcatctatgatgcatccagcagggccactggcatcccagccaggttcagtggcagtgggcctgggacagacttcactctcaccatcagcagcctagagcctgaagattttgcagtttattactgtcagc

SEQ ID NO: 786 - DNA, 271 bp, Homo sapiens
  IGKV3-NL3*01
gaaattgtgttgacacagtctccaggcaccctgtctttgtctccaggggaaagagccaccctctcctgcagggccagtcagagtgttagcagcagctacttagcctggtaccagcagaaacctggcctggcgcccaggctcctcatctatggtgcatccaccagggccactggtatcccagccaggttcagtggcagtgggtctgggacagagttcactctcaccatcagcagactgcagtctgaagattttgcagtttattactgtcagc

SEQ ID NO: 787 - DNA, 285 bp, Homo sapiens
  IGKV3-NL4*01
gaaattgtgttgacacagtctccagccaccctgtctttgtctccaggggaaagagccaccctctcctgcagggccagtcagggtgttagcagcaacttagcctggtaccagcagaaacctggccaggctcccaggctcctcatctatgatgcatccaacagggccactggcatcccagccaggttcagtggcagtgggcctgggacagacttcactctcaccatcagcagcctagagcctgaagattttgcagtgtattactgtcagcagcgtagcaactggcat

SEQ ID NO: 788 - DNA, 288 bp, Homo sapiens
  IGKV3-NL5*01
gaaattgtgttgacgcagtctccagccaccctgtctttgtctccaggggaaagagccaccctctcctgcagggccagtcagagtgttagcagcagctacttagcctggtaccagcagaaacctggccaggctcccaggctcctcatctatgatgcatccagcagggccactggcatcccagacaggttcagtggcagtgggtctgggacagacttcactctcaccatcagcagactggagcctgaagattttgcagtctattactgtcagcagcgtagcaactggcat

SEQ ID NO: 789 - DNA, 290 bp, Homo sapiens
  IGKV3/OR2-268*01
gaaattgtaatgacacagtctccagccaccctgtctttgtctccaggggaaagagccaccctctcctgcagggccagtcagagtgttagcagcagctacttatcctggtaccagcagaaacctgggcaggctcccaggctcctcatctatggtgcatccaccagggccactggcatcccagccaggttcagtggtagtgggtctgggacagacttcactctcaccatcagcagcctgcagcctgaagattttgcagtttattactgtcagcaggattataacttacctcc

SEQ ID NO: 790 - DNA, 290 bp, Homo sapiens
  IGKV3/OR2-268*02
gaaattgtaatgacacagtctccagccaccctgtctttgtctccaggggaaagagccaccctctcctgcagggccagtcagagtgttagcagcagctacttatcctggtaccagcagaaacctgggcaggctcccaggctcctcatctatggtgcatccaccagggccactggcatcccagccaggttcagtggcagtgggtctgggacagacttcactctcaccatcagcagcctgcagcctgaagattttgcagtttattactgtcagcaggattataacttacctcc

SEQ ID NO: 791 - DNA, 287 bp, Homo sapiens
  IGKV3D-11*01
gaaattgtgttgacacagtctccagccaccctgtctttgtctccaggggaaagagccaccctctcctgcagggccagtcagggtgttagcagctacttagcctggtaccagcagaaacctggccaggctcccaggctcctcatctatgatgcatccaacagggccactggcatcccagccaggttcagtggcagtgggcctgggacagacttcactctcaccatcagcagcctagagcctgaagattttgcagtttattactgtcagcagcgtagcaactggcatcc

SEQ ID NO: 792 - DNA, 287 bp, Homo sapiens
  IGKV3D-15*01
gaaatagtgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactggcatcccagccaggttcagtggcagtgggtctgggacagagttcactctcaccatcagcagcctgcagtctgaagattttgcagtttattactgtcagcagtataataactggcctcc

SEQ ID NO: 793 - DNA, 290 bp, Homo sapiens
  IGKV3D-20*01
gaaattgtgttgacgcagtctccagccaccctgtctttgtctccaggggaaagagccaccctctcctgcggggccagtcagagtgttagcagcagctacttagcctggtaccagcagaaacctggcctggcgcccaggctcctcatctatgatgcatccagcagggccactggcatcccagacaggttcagtggcagtgggtctgggacagacttcactctcaccatcagcagactggagcctgaagattttgcagtgtattactgtcagcagtatggtagctcacctcc

SEQ ID NO: 794 - DNA, 290 bp, Homo sapiens; identical to SEQ ID NO: 790
  IGKV3D-7*01

SEQ ID NO: 795 - DNA, 38 bp, Homo sapiens
  IGKJ1*01
gtggacgttcggccaagggaccaaggtggaaatcaaac

SEQ ID NO: 796 - DNA, 297 bp, Homo sapiens
  IGLV2-11*01
cagtctgccctgactcagcctcgctcagtgtccgggtctcctggacagtcagtcaccatctcctgcactggaaccagcagtgatgttggtggttataactatgtctcctggtaccaacagcacccaggcaaagcccccaaactcatgatttatgatgtcagtaagcggccctcaggggtccctgatcgcttctctggctccaagtctggcaacacggcctccctgaccatctctgggctccaggctgaggatgaggctgattattactgctgctcatatgcaggcagctacactttc

SEQ ID NO: 797 - DNA, 297 bp, Homo sapiens
  IGLV2-11*02
cagtctgccctgactcagcctcgctcagtgtccgggtctcctggacagtcagtcaccatctcctgcactggaaccagcagtgatgttggtgggtataactatgtctcctggtaccaacagcacccaggcaaagcccccaaactcatgatttatgatgtcagtaagcggccctcaggggtccctgatcgcttctctggctccaagtctggcaacacggcctccctgaccatctctgggctccaggctgaggatgaggctgattattactgctgctcatatgcaggcagctacactttc

SEQ ID NO: 798 - DNA, 274 bp, Homo sapiens
  IGLV2-11*03
ctcagtgtccgggtctcctggacagtcagtcaccatctcctgcactggaaccagcagtgatgttggtggttataactatgtctcctggtaccaacaacacccaggcaaagcccccaaactcatgatttatgatgtcagtaagcggccctcaggggtccctgatcgcttctctggctccaagtctggcaacacggcctccctgaccatctctgggctccaggctgaggatgaggctgattattactgctgctcatatgcaggcagctacactttc

SEQ ID NO: 799 - DNA, 297 bp, Homo sapiens
  IGLV2-14*01
cagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgaggtcagtaatcggccctcaggggtttctaatcgcttctctggctccaagtctggcaacacggcctccctgaccatctctgggctccaggctgaggacgaggctgattattactgcagctcatatacaagcagcagcactctc

SEQ ID NO: 800 - DNA, 297 bp, Homo sapiens
  IGLV2-14*02
cagtctgccctgactcagcctgcctccgtgtctgggtctcctggacagtcgatcaccatctcctgcactggaaccagcagtgatgttgggagttataaccttgtctcctggtaccaacagcacccaggcaaagcccccaaactcatgatttatgagggcagtaagcggccctcaggggtttctaatcgcttctctggctccaagtctggcaacacggcctccctgaccatctctgggctccaggctgaggacgaggctgattattactgcagctcatatacaagcagcagcactctc

SEQ ID NO: 801 - DNA, 274 bp, Homo sapiens
  IGLV2-14*03
ctccgtgtctgggtctcctggacagtcgatcaccatctcctgcactggaaccagcagtgacgttggtggttataactatgtctcctggtaccaacaacacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactctc

SEQ ID NO: 802 - DNA, 274 bp, Homo sapiens
  IGLV2-14*04
ctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactctc

SEQ ID NO: 803 - DNA, 297 bp, Homo sapiens
  IGLV2-18*01
cagtctgccctgactcagcctccctccgtgtccgggtctcctggacagtcagtcaccatctcctgcactggaaccagcagtgacgttggtagttataaccgtgtctcctggtaccagcagcccccaggcacagcccccaaactcatgatttatgaggtcagtaatcggccctcaggggtccctgatcgcttctctgggtccaagtctggcaacacggcctccctgaccatctctgggctccaggctgaggacgaggctgattattactgcagcttatatacaagcagcagcactttc

SEQ ID NO: 804 - DNA, 297 bp, Homo sapiens
  IGLV2-18*02
cagtctgccctgactcagcctccctccgtgtccgggtctcctggacagtcagtcaccatctcctgcactggaaccagcagtgacgttggtagttataaccgtgtctcctggtaccagcagcccccaggcacagcccccaaactcatgatttatgaggtcagtaatcggccctcaggggtccctgatcgcttctctgggtccaagtctggcaacacggcctccctgaccatctctgggctccaggctgaggacgaggctgattattactgcagctcatatacaagcagcagcactttc

SEQ ID NO: 805 - DNA, 297 bp, Homo sapiens
  IGLV2-18*03
cagtctgccctgactcagcctccctccgtgtccgggtctcctggacagtcagtcaccatctcctgcactggaaccagcagtgacgttggtagttataaccgtgtctcctggtaccagcagcccccaggcacagcccccaaactcatgatttatgaggtcagtaatcggccctcaggggtccctgatcgcttctctgggtccaagtctggcaacacggcctccctgaccacctctgggctccaggctgaggacgaggctgattattactgcagctcatatacaagcagcagcactttc

SEQ ID NO: 806 - DNA, 297 bp, Homo sapiens
  IGLV2-18*04
cagtctgccctgactcagcctccctccgtgtccgggtctcctggacagtcagtcaccatctcctgcactggaaccagcagtgacgttggtagttataaccgtgtctcctggtaccagcagcccccaggcacagcccccaaactcatgatttatgaggtcagtaatcggccctcaggggtccctgatcgctcctctgggtccaagtccggcaacacggcctccctgaccatctctgggctccaggctgaggacgaggctgattattactgcagctcatatacaagcagcagcactttc

SEQ ID NO: 807 - DNA, 298 bp, Homo sapiens
  IGLV2-23*01
cagtctgccctgactcagcctgcctccgtgtctgggtctcctggacagtcgatcaccatctcctgcactggaaccagcagtgatgttgggagttataaccttgtctcctggtaccaacagcacccaggcaaagcccccaaactcatgatttatgagggcagtaagcggccctcaggggtttctaatcgcttctctggctccaagtctggcaacacggcctccctgacaatctctgggctccaggctgaggacgaggctgattattactgctgctcatatgcaggtagtagcactttac

SEQ ID NO: 808 - DNA, 297 bp, Homo sapiens
  IGLV2-23*02
cagtctgccctgactcagcctgcctccgtgtctgggtctcctggacagtcgatcaccatctcctgcactggaaccagcagtgatgttgggagttataaccttgtctcctggtaccaacagcacccaggcaaagcccccaaactcatgatttatgaggtcagtaagcggccctcaggggtttctaatcgcttctctggctccaagtctggcaacacggcctccctgacaatctctgggctccaggctgaggacgaggctgattattactgctgctcatatgcaggtagtagcactttc

SEQ ID NO: 809 - DNA, 297 bp, Homo sapiens
  IGLV2-23*03
cagtctgccctgactcagcctgcctccgtgtctgggtctcctggacagtcgatcaccatctcctgcactggaaccagcagtgatgttgggagttataaccttgtctcctggtaccaacagcacccaggcaaagcccccaaactcatgatttatgagggcagtaagcggccctcaggggtttctaatcgcttctctggctccaagtctggcaacacggcctccctgacaatctctgggctccaggctgaggacgaggctgattattactgctgctcatatgcaggtagtagcactttc

SEQ ID NO: 810 - DNA, 297 bp, Homo sapiens
  IGLV2-33*01
caatctgccctgactcagcctccttttgtgtccggggctcctggacagtcggtcaccatctcctgcactggaaccagcagtgacgttggggattatgatcatgtcttctggtaccaaaagcgtctcagcactacctccagactcctgatttacaatgtcaatactcggccttcagggatctctgacctcttctcaggctccaagtctggcaacatggcttccctgaccatctctgggctcaagtccgaggttgaggctaattatcactgcagcttatattcaagtagttacactttc

SEQ ID NO: 811 - DNA, 297 bp, Homo sapiens
  IGLV2-33*02
cagtctgccctgactcagcctccttttgtgtccggggctcctggacagtcggtcaccatctcctgcactggaaccagcagtgacgttggggattatgatcatgtcttctggtaccaaaagcgtctcagcactacctccagactcctgatttacaatgtcaatactcggccttcagggatctctgacctcttctcaggctccaagtctggcaacatggcttccctgaccatctctgggctcaagtccgaggttgaggctaattatcactgcagcttatattcaagtagttacactttc

SEQ ID NO: 812 - DNA, 297 bp, Homo sapiens
  IGLV2-33*03
caatctgccctgactcagcctccttttgtgtccggggctcctggacagtcggtcaccatctcctgcactggaaccagcagtgacgttggggactatgatcatgtcttctggtaccaaaagcgtctcagcactacctccagactcctgatttacaatgtcaatactcggccttcagggatctctgacctcttctcaggctccaagtctggcaacgtggcttccctgaccatctctgggctcaagtccgaggttgaggctaattatcactgcagcttatattcaagtagttacactttc

SEQ ID NO: 813 - DNA, 297 bp, Homo sapiens
  IGLV2-8*01
cagtctgccctgactcagcctccctccgcgtccgggtctcctggacagtcagtcaccatctcctgcactggaaccagcagtgacgttggtggttataactatgtctcctggtaccaacagcacccaggcaaagcccccaaactcatgatttatgaggtcagtaagcggccctcaggggtccctgatcgcttctctggctccaagtctggcaacacggcctccctgaccgtctctgggctccaggctgaggatgaggctgattattactgcagctcatatgcaggcagcaacaatttc

SEQ ID NO: 814 - DNA, 297 bp, Homo sapiens
  IGLV2-8*02
cagtctgccctgactcagcctccctccgcgtccaggtctcctggacagtcagtcaccatctcctgcactggaaccagcagtgacgttggtggttataactatgtctcctggtaccaacagcacccaggcaaagcccccaaactcatgatttatgaggtcagtaagcggccctcaggggtccctgatcgcttctctggctccaagtctggcaacacggcctccctgaccgtctctgggctccaggctgaggatgaggctgattattactgcagctcatatgcaggcagcaacaatttc

SEQ ID NO: 815 - DNA, 274 bp, Homo sapiens
  IGLV2-8*03
ctccgcgtccgggtctcctggacagtcagtcaccatctcctgcactggaaccagcagtgacgttggtggttataactatgtctcctggtaccaacagcacccaggcaaagcccccaaactcatgatttatgaggtcagtaagcggccctcaggggtccctgatcgcttctttggctccaagtctggcaacacggcctccctgaccgtctctgggctccaggctgaggatgaggctgattattactgcagctcatatgcaggcagcaacaatttc

SEQ ID NO: 816 - DNA, 312 bp, Homo sapiens
  IGLV5-37*01
cagcctgtgctgactcagccaccttcctcctccgcatctcctggagaatccgccagactcacctgcaccttgcccagtgacatcaatgttggtagctacaacatatactggtaccagcagaagccagggagccctcccaggtatctcctgtactactactcagactcagataagggccagggctctggagtccccagccgcttctctggatccaaagatgcttcagccaatacagggattttactcatctccgggctccagtctgaggatgaggctgactattactgtatgatttggccaagcaatgcttct

SEQ ID NO: 817 - DNA, 312 bp, Homo sapiens
  IGLV5-39*01
cagcctgtgctgactcagccaacctccctctcagcatctcctggagcatcagccagattcacctgcaccttgcgcagtggcatcaatgttggtacctacaggatatactggtaccagcagaagccagggagtcttccccggtatctcctgaggtacaaatcagactcagataagcagcagggctctggagtccccagccgcttctctggatccaaagatgcttcaaccaatgcaggccttttactcatctctgggctccagtctgaagatgaggctgactattactgtgccatttggtacagcagcacttct

SEQ ID NO: 818 - DNA, 312 bp, Homo sapiens
  IGLV5-39*02
cagcctgtgctgactcagccaacctccctctcagcatctcctggagcatcagccagattcacctgcaccttgcgcagcggcatcaatgttggtacctacaggatatactggtaccagcagaatccagggagtcttccccggtatctcctgaggtacaaatcagactcagataagcagcagggctctggagtccccagccgcttctctggatccaaagatgcttcaaccaatgcaggccttttactcatctctgggctccagtctgaagatgaggctgactattactgtgccatttggtacagcagcacttct

SEQ ID NO: 819 - DNA, 312 bp, Homo sapiens
  IGLV5-45*01
caggctgtgctgactcagccggcttccctctctgcatctcctggagcatcagccagtctcacctgcaccttgcgcagtggcatcaatgttggtacctacaggatatactggtaccagcagaagccagggagtcctccccagtatctcctgaggtacaaatcagactcagataagcagcagggctctggagtccccagccgcttctctggatccaaagatgcttcggccaatgcagggattttactcatctctgggctccagtctgaggatgaggctgactattactgtatgatttggcacagcagcgcttct

SEQ ID NO: 820 - DNA, 312 bp, Homo sapiens
  IGLV5-45*02
caggctgtgctgactcagccgtcttccctctctgcatctcctggagcatcagccagtctcacctgcaccttacgcagtggcatcaatgttggtacctacaggatatactggtaccagcagaagccagggagtcctccccagtatctcctgaggtacaaatcagactcagataagcagcagggctctggagtccccagccgcttctctggatccaaagatgcttcggccaatgcagggattttactcatctctgggctccagtctgaggatgaggctgactattactgtatgatttggcacagcagcgcttct

SEQ ID NO: 821 - DNA, 312 bp, Homo sapiens
  IGLV5-45*03
caggctgtgctgactcagccgtcttccctctctgcatctcctggagcatcagccagtctcacctgcaccttgcgcagtggcatcaatgttggtacctacaggatatactggtaccagcagaagccagggagtcctccccagtatctcctgaggtacaaatcagactcagataagcagcagggctctggagtccccagccgcttctctggatccaaagatgcttcggccaatgcagggattttactcatctctgggctccagtctgaggatgaggctgactattactgtatgatttggcacagcagcgcttct

SEQ ID NO: 822 - DNA, 312 bp, Homo sapiens
  IGLV5-48*01
cagcctgtgctgactcagccaacttccctctcagcatctcctggagcatcagccagactcacctgcaccttgcgcagtggcatcaatcttggtagctacaggatattctggtaccagcagaagccagagagccctccccggtatctcctgagctactactcagactcaagtaagcatcagggctctggagtccccagccgcttctctggatccaaagatgcttcgagcaatgcagggattttagtcatctctgggctccagtctgaggatgaggctgactattactgtatgatttggcacagcagtgcttct

SEQ ID NO: 823 - DNA, 317 bp, Homo sapiens
  IGLV5-52*01
cagcctgtgctgactcagccatcttcccattctgcatcttctggagcatcagtcagactcacctgcatgctgagcagtggcttcagtgttggggacttctggataaggtggtaccaacaaaagccagggaaccctccccggtatctcctgtactaccactcagactccaataagggccaaggctctggagttcccagccgcttctctggatccaacgatgcatcagccaatgcagggattctgcgtatctctgggctccagcctgaggatgaggctgactattactgtggtacatggcacagcaactctaagactca

SEQ ID NO: 824 - DNA, 296 bp, Homo sapiens
  IGLV8-61*01
cagactgtggtgacccaggagccatcgttctcagtgtcccctggagggacagtcacactcacttgtggcttgagctctggctcagtctctactagttactaccccagctggtaccagcagaccccaggccaggctccacgcacgctcatctacagcacaaacactcgctcttctggggtccctgatcgcttctctggctccatccttgggaacaaagctgccctcaccatcacgggggcccaggcagatgatgaatctgattattactgtgtgctgtatatgggtagtggcatttc

SEQ ID NO: 825 - DNA, 296 bp, Homo sapiens
  IGLV8-61*02
cagactgtggtgacccaggagccatcgttctcagtgtcccctggagggacagtcacactcacttgtggcttgagctctggctcagtctctactagttactaccccagctggtaccagcagaccccaggccaggctccacgcacgctcatctacagcacaaacactcgctcttctggggtccctgattgcttctctggctccatccttgggaacaaagctgccctcaccatcacgggggcccaggcagatgatgaatctgattattactgtgtgctgtatatgggtagtggcatttc

SEQ ID NO: 826 - DNA, 247 bp, Homo sapiens
  IGLV8-61*03
ggtgacccaggagccatcgttctcagtgtcccctggagggacagtcacactcacttgtggcttgagctctggctcagtctctactagttactaccccagctggtaccagcagaccccaggccaggctccacgcacgctcatctacagcacaaacactcgctcttctggcgtccctgatcgcttctctggctccatccttgggaacaaagctgccctcaccatcacgggggcccaggcagatgatgaa

SEQ ID NO: 827 - DNA, 312 bp, Homo sapiens
  IGLV11-55*01
cggcccgtgctgactcagccgccctctctgtctgcatccccgggagcaacagccagactcccctgcaccctgagcagtgacctcagtgttggtggtaaaaacatgttctggtaccagcagaagccagggagctctcccaggttattcctgtatcactactcagactcagacaagcagctgggacctggggtccccagtcgagtctctggctccaaggagacctcaagtaacacagcgtttttgctcatctctgggctccagcctgaggacgaggccgattattactgccaggtgtacgaaagtagtgctaat

SEQ ID NO: 828 - DNA, 38 bp, Homo sapiens
  IGLJ1*01
ttatgtcttcggaactgggaccaaggtcaccgtcctag

SEQ ID NO: 829 - DNA, 38 bp, Homo sapiens
  IGLJ4*01
ttttgtatttggtggaggaacccagctgatcattttag

SEQ ID NO: 830 - protein, 10 aa, Artificial Sequence
  Description of Artificial Sequence: Synthetic peptide
  CDRH1
GYTFTSYYMH

SEQ ID NO: 831 - protein, 10 aa, Artificial Sequence
  Description of Artificial Sequence: Synthetic peptide
  CDRH1
GYSFTSYWIG

SEQ ID NO: 832 - protein, 10 aa, Artificial Sequence
  Description of Artificial Sequence: Synthetic peptide
  CDRH1
GDSVSSNSAA

SEQ ID NO: 833 - protein, 10 aa, Artificial Sequence
  Description of Artificial Sequence: Synthetic peptide
  CDRH1
GGSFSGYYWS

SEQ ID NO: 834 - protein, 10 aa, Artificial Sequence
  Description of Artificial Sequence: Synthetic peptide
  CDRH1
GYTFTSYAMH

SEQ ID NO: 835 - protein, 10 aa, Artificial Sequence
  Description of Artificial Sequence: Synthetic peptide
  CDRH1
GYTFTSYAIN

SEQ ID NO: 836 - protein, 10 aa, Artificial Sequence
  Description of Artificial Sequence: Synthetic peptide
  CDRH1
GGSISSGGYY

SEQ ID NO: 837 - protein, 5 aa, Artificial Sequence
  Description of Artificial Sequence: Synthetic peptide
  CDRH1
SYYMH

SEQ ID NO: 838 - protein, 5 aa, Artificial Sequence
  Description of Artificial Sequence: Synthetic peptide
  CDRH1
SYWIG

SEQ ID NO: 839 - protein, 5 aa, Artificial Sequence
  Description of Artificial Sequence: Synthetic peptide
  CDRH1
SNSAA

SEQ ID NO: 840 - protein, 5 aa, Artificial Sequence
  Description of Artificial Sequence: Synthetic peptide
  CDRH1
GYYWS

SEQ ID NO: 841 - protein, 5 aa, Artificial Sequence
  Description of Artificial Sequence: Synthetic peptide
  CDRH1
SYAMH

SEQ ID NO: 842 - protein, 5 aa, Artificial Sequence
  Description of Artificial Sequence: Synthetic peptide
  CDRH1
SYAIN

SEQ ID NO: 843 - protein, 5 aa, Artificial Sequence
  Description of Artificial Sequence: Synthetic peptide
  CDRH1
SGGYY

SEQ ID NO: 844 - protein, 17 aa, Artificial Sequence
  Description of Artificial Sequence: Synthetic peptide
  CDRH2
IINPSGGSTSYAQKFQG

SEQ ID NO: 845 - protein, 17 aa, Artificial Sequence
  Description of Artificial Sequence: Synthetic peptide
  CDRH2
IIYPGDSDTRYSPSFQG

SEQ ID NO: 846 - protein, 18 aa, Artificial Sequence
  Description of Artificial Sequence: Synthetic peptide
  CDRH2
RTYYRSKWYNDYAVSVKS

SEQ ID NO: 847 - protein, 16 aa, Artificial Sequence
  Description of Artificial Sequence: Synthetic peptide
  CDRH2
EINHSGSTNYNPSLKS

SEQ ID NO: 848 - protein, 18 aa, Artificial Sequence
  Description of Artificial Sequence: Synthetic peptide
  CDRH2
INSNAGNGNTKYSQEFQG

SEQ ID NO: 849 - protein, 17 aa, Artificial Sequence
  Description of Artificial Sequence: Synthetic peptide
  CDRH2
WMNPNSGNTGYAQKFQG

SEQ ID NO: 850 - protein, 16 aa, Artificial Sequence
  Description of Artificial Sequence: Synthetic peptide
  CDRH2
YIYYSGSTYYNPSLKS

SEQ ID NO: 851 - protein, 13 aa, Artificial Sequence
  Description of Artificial Sequence: Synthetic peptide
  CDRH3
EEYSSSSAEYFQH

SEQ ID NO: 852 - protein, 12 aa, Artificial Sequence
  Description of Artificial Sequence: Synthetic peptide
  CDRH3
RGYSYGYDYFDY

SEQ ID NO: 853 - protein, 16 aa, Artificial Sequence
  Description of Artificial Sequence: Synthetic peptide
  CDRH3
EYYDFWSGYYTDYFDY

SEQ ID NO: 854 - protein, 13 aa, Artificial Sequence
  Description of Artificial Sequence: Synthetic peptide
  CDRH3
EGYSSSWYDYFDY

SEQ ID NO: 855 - protein, 9 aa, Artificial Sequence
  Description of Artificial Sequence: Synthetic peptide
  CDRH3
ANWGDYFDY

SEQ ID NO: 856 - protein, 12 aa, Artificial Sequence
  Description of Artificial Sequence: Synthetic peptide
  CDRH3
DDYGGNSDYFDY

SEQ ID NO: 857 - protein, 11 aa, Artificial Sequence
  Description of Artificial Sequence: Synthetic peptide
  CDRH3
EGYCSGGSCYS

SEQ ID NO: 858 - protein, 16 aa, Artificial Sequence
  Description of Artificial Sequence: Synthetic peptide
  CDRH3
EYYYGSGSYYNDYFDY

SEQ ID NO: 859 - protein, 21 aa, Artificial Sequence
  Description of Artificial Sequence: Synthetic peptide
  CDRH3
GCYCSSTSCYADYYYYYGMDV

SEQ ID NO: 860 - protein, 11 aa, Artificial Sequence
  Description of Artificial Sequence: Synthetic peptide
  CDRH3
GSCYSYWYFDL

SEQ ID NO: 861 - protein, 11 aa, Artificial Sequence
  Description of Artificial Sequence: Synthetic peptide
  CDRL1
RASQSVSSYLA

SEQ ID NO: 862 - protein, 14 aa, Artificial Sequence
  Description of Artificial Sequence: Synthetic peptide
  CDRL1
GLSSGSVSTSYYPS

SEQ ID NO: 863 - protein, 14 aa, Artificial Sequence
  Description of Artificial Sequence: Synthetic peptide
  CDRL1
TLRSGINLGSYRIF

SEQ ID NO: 864 - protein, 11 aa, Artificial Sequence
  Description of Artificial Sequence: Synthetic peptide
  CDRL1
RASQSVSSNLA

SEQ ID NO: 865 - protein, 11 aa, Artificial Sequence
  Description of Artificial Sequence: Synthetic peptide
  CDRL1
RASQGISSWLA

SEQ ID NO: 866 - protein, 11 aa, Artificial Sequence
  Description of Artificial Sequence: Synthetic peptide
  CDRL1
RASQVSSSYLA

SEQ ID NO: 867 - protein, 11 aa, Artificial Sequence
  Description of Artificial Sequence: Synthetic peptide
  CDRL1
RASQSISSWLA

SEQ ID NO: 868 - protein, 17 aa, Artificial Sequence
  Description of Artificial Sequence: Synthetic peptide
  CDRL1
RSSQSLLDSDDGNTYLD

SEQ ID NO: 869 - protein, 14 aa, Artificial Sequence [sequence omitted]

SEQ ID NO: 870 - protein, 14 aa, Artificial Sequence
  Description of Artificial Sequence: Synthetic peptide
  CDRL1
TLSSDLSVGGKNMF

SEQ ID NO: 871 - protein, 7 aa, Artificial Sequence
  Description of Artificial Sequence: Synthetic peptide
  CDRL2
DASNRAT

SEQ ID NO: 872 - protein, 7 aa, Artificial Sequence
  Description of Artificial Sequence: Synthetic peptide
  CDRL2
STNTRSS

SEQ ID NO: 873 - protein, 7 aa, Artificial Sequence
  Description of Artificial Sequence: Synthetic peptide
  CDRL2
YYSDSSK

SEQ ID NO: 874 - protein, 7 aa, Artificial Sequence
  Description of Artificial Sequence: Synthetic peptide
  CDRL2
GASTRAT

SEQ ID NO: 875 - protein, 7 aa, Artificial Sequence
  Description of Artificial Sequence: Synthetic peptide
  CDRL2
AASSLQS

SEQ ID NO: 876 - protein, 7 aa, Artificial Sequence
  Description of Artificial Sequence: Synthetic peptide
  CDRL2
GASSRAT

SEQ ID NO: 877 - protein, 7 aa, Artificial Sequence
  Description of Artificial Sequence: Synthetic peptide
  CDRL2
DASSLGS

SEQ ID NO: 878 - protein, 7 aa, Artificial Sequence
  Description of Artificial Sequence: Synthetic peptide
  CDRL2
TLSYRAS

SEQ ID NO: 879 - protein, 7 aa, Artificial Sequence
  Description of Artificial Sequence: Synthetic peptide
  CDRL2
EVSNRPS

SEQ ID NO: 880 - protein, 7 aa, Artificial Sequence
  Description of Artificial Sequence: Synthetic peptide
  CDRL2
HYSDSDK

SEQ ID NO: 881 - protein, 10 aa, Artificial Sequence
  Description of Artificial Sequence: Synthetic peptide
  CDRL3
QQRSNWPPWT

SEQ ID NO: 882 - protein, 11 aa, Artificial Sequence
  Description of Artificial Sequence: Synthetic peptide
  CDRL3
VLYMGSGISYV

SEQ ID NO: 883 - protein, 10 aa, Artificial Sequence
  Description of Artificial Sequence: Synthetic peptide
  CDRL3
MIWHSSASFV

SEQ ID NO: 884 - protein, 10 aa, Artificial Sequence [sequence omitted]

SEQ ID NO: 885 - protein, 9 aa, Artificial Sequence
  Description of Artificial Sequence: Synthetic peptide
  CDRL3
QANSFPPWT

SEQ ID NO: 886 - protein, 10 aa, Artificial Sequence
  Description of Artificial Sequence: Synthetic peptide
  CDRL3
QQYGSSPPWT

SEQ ID NO: 887 - protein, 10 aa, Artificial Sequence
  Description of Artificial Sequence: Synthetic peptide
  CDRL3
QQYNSYSPWT

SEQ ID NO: 888 - protein, 10 aa, Artificial Sequence
  Description of Artificial Sequence: Synthetic peptide
  CDRL3
MQRIEFPSWT

SEQ ID NO: 889 - protein, 11 aa, Artificial Sequence
  Description of Artificial Sequence: Synthetic peptide
  CDRL3
SSYTSSSTLFV

SEQ ID NO: 890 - protein, 10 aa, Artificial Sequence
  Description of Artificial Sequence: Synthetic peptide
  CDRL3
QVYESSANFV

SEQ ID NO: 891 - protein, 330 aa, Artificial Sequence [sequence omitted]

SEQ ID NO: 892 - protein, 107 aa, Artificial Sequence [sequence omitted]

SEQ ID NO: 893 - protein, 106 aa, Artificial Sequence
  Description of Artificial Sequence: Synthetic polypeptide
  CL Lambda
GQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 894 - protein, 123 aa, Artificial Sequence
  Description of Artificial Sequence: Synthetic polypeptide
  VH5-51_IGHD5-18*01>3_IGHJ4*01 G100K/G104T Y27A
EVQLVQSGAEVKKPGESLKISCKGSGASFTSYWIGWVRQMPGKGLEWMGIIYPGDSDTRYSPSFQGQVTISADKSISTAYLQWSSLKASDTAMYYCARRKYSYTYDYFDYWGQGTLVTVSSAS

SEQ ID NO: 895 - protein, 123 aa, Artificial Sequence
  Description of Artificial Sequence: Synthetic polypeptide
  VH5-51_IGHD5-18*01>3_IGHJ4*01 G100K/G104T S31A
EVQLVQSGAEVKKPGESLKISCKGSGYSFTAYWIGWVRQMPGKGLEWMGIIYPGDSDTRYSPSFQGQVTISADKSISTAYLQWSSLKASDTAMYYCARRKYSYTYDYFDYWGQGTLVTVSSAS

SEQ ID NO: 896 - protein, 123 aa, Artificial Sequence
  Description of Artificial Sequence: Synthetic polypeptide
  VH5-51_IGHD5-18*01>3_IGHJ4*01 G100K/G104T Y32A
EVQLVQSGAEVKKPGESLKISCKGSGYSFTSAWIGWVRQMPGKGLEWMGIIYPGDSDTRYSPSFQGQVTISADKSISTAYLQWSSLKASDTAMYYCARRKYSYTYDYFDYWGQGTLVTVSSAS

SEQ ID NO: 897 - protein, 123 aa, Artificial Sequence
  Description of Artificial Sequence: Synthetic polypeptide
  VH5-51_IGHD5-18*01>3_IGHJ4*01 G100K/G104T G54A
EVQLVQSGAEVKKPGESLKISCKGSGYSFTSYWIGWVRQMPGKGLEWMGIIYPADSDTRYSPSFQGQVTISADKSISTAYLQWSSLKASDTAMYYCARRKYSYTYDYFDYWGQGTLVTVSSAS

SEQ ID NO: 898 - protein, 123 aa, Artificial Sequence
  Description of Artificial Sequence: Synthetic polypeptide
  VH5-51_IGHD5-18*01>3_IGHJ4*01 G100K/G104T S56A
EVQLVQSGAEVKKPGESLKISCKGSGYSFTSYWIGWVRQMPGKGLEWMGIIYPGDADTRYSPSFQGQVTISADKSISTAYLQWSSLKASDTAMYYCARRKYSYTYDYFDYWGQGTLVTVSSAS

SEQ ID NO: 899 - protein, 2555 aa, Homo sapiens
  Notch-1 (P46531)
MPPLLAPLLCLALLPALAARGPRCSQPGETCLNGGKCEAANGTEACVCGGAFVGPRCQDPNPCLSTPCKNAGTCHVVDRRGVADYACSCALGFSGPLCLTPLDNACLTNPCRNGGTCDLLTLTEYKCRCPPGWSGKSCQQADPCASNPCANGGQCLPFEASYICHCPPSFHGPTCRQDVNECGQKPGLCRHGGTCHNEVGSYRCVCRATHTGPNCERPYVPCSPSPCQNGGTCRPTGDVTHECACLPGFTGQNCEENIDDCPGNNCKNGGACVDGVNTYNCRCPPEWTGQYCTEDVDECQLMPNACQNGGTCHNTHGGYNCVCVNGWTGEDCSENIDDCASAACFHGATCHDRVASFYCECPHGRTGLLCHLNDACISNPCNEGSNCDTNPVNGKAICTCPSGYTGPACSQDVDECSLGANPCEHAGKCINTLGSFECQCLQGYTGPRCEIDVNECVSNPCQNDATCLDQIGEFQCICMPGYEGVHCEVNTDECASSPCLHNGRCLDKINEFQCECPTGFTGHLCQYDVDECASTPCKNGAKCLDGPNTYTCVCTEGYTGTHCEVDIDECDPDPCHYGSCKDGVATFTCLCRPGYTGHHCETNINECSSQPCRHGGTCQDRDNAYLCFCLKGTTGPNCEINLDDCASSPCDSGTCLDKIDGYECACEPGYTGSMCNINIDECAGNPCHNGGTCEDGINGFTCRCPEGYHDPTCLSEVNECNSNPCVHGACRDSLNGYKCDCDPGWSGTNCDINNNECESNPCVNGGTCKDMTSGYVCTCREGFSGPNCQTNINECASNPCLNQGTCIDDVAGYKCNCLLPYTGATCEVVLAPCAPSPCRNGGECRQSEDYESFSCVCPTGWQGQTCEVDINECVLSPCRHGASCQNTHGGYRCHCQAGYSGRNCETDIDDCRPNPCHNGGSCTDGINTAFCDCLPGFRGTFCEEDINECASDPCRNGANCTDCVDSYTCTCPAGFSGIHCENNTPDCTESSCFNGGTCVDGINSFTCLCPPGFTGSYCQHDVNECDSQPCLHGGTCQDGCGSYRCTCPQGYTGPNCQNLVHWCDSSPCKNGGKCWQTHTQYRCECPSGWTGLYCDVPSVSCEVAAQRQGVDVARLCQHGGLCVDAGNTHHCRCQAGYTGSYCEDLVDECSPSPCQNGATCTDYLGGYSCKCVAGYHGVNCSEEIDECLSHPCQNGGTCLDLPNTYKCSCPRGTQGVHCEINVDDCNPPVDPVSRSPKCFNNGTCVDQVGGYSCTCPPGFVGERCEGDVNECLSNPCDARGTQNCVQRVNDFHCECRAGHTGRRCESVINGCKGKPCKNGGTCAVASNTARGFICKCPAGFEGATCENDARTCGSLRCLNGGTCISGPRSPTCLCLGPFTGPECQFPASSPCLGGNPCYNQGTCEPTSESPFYRCLCPAKFNGLLCHILDYSFGGGAGRDIPPPLIEEACELPECQEDAGNKVCSLQCNNHACGWDGGDCSLNFNDPWKNCTQSLQCWKYFSDGHCDSQCNSAGCLFDGFDCQRAEGQCNPLYDQYCKDHFSDGHCDQGCNSAECEWDGLDCAEHVPERLAAGTLVVVVLMPPEQLRNSSFHFLRELSRVLHTNVVFKRDAHGQQMIFPYYGREEELRKHPIKRAAEGWAAPDALLGQVKASLLPGGSEGGRRRRELDPMDVRGSIVYLEIDNRQCVQASSQCFQSATDVAAFLGALASLGSLNIPYKIEAVQSETVEPPPPAQLHFMYVAAAAFVLLFFVGCGVLLSRKRRRQHGQLWFPEGFKVSEASKKKRREPLGEDSVGLKPLKNASDGALMDDNQNEWGDEDLETKKFRFEEPVVLPDLDDQTDHRQWTQQHLDAADLRMSAMAPTPPQGEVDADCMDVNVRGPDGFTPLMIASCSGGGLETGNSEEEEDAPAVISDFIYQGASLHNQTDRTGETALHLAARYSRSDAAKRLLEASADANIQDNMGRTPLHAAVSADAQGVFQILIRNRATDLDARMHDGTTPLILAARLAVEGMLEDLINSHADVNAVDDLGKSALHWAAAVNNVDAAVVLLKNGANKDMQNNREETPLFLAAREGSYETAKVLLDHFANRDITDHMDRLPRDIAQERMHHDIVRLLDEYNLVRSPQLHGAPLGGTPTLSPPLCSPNGYLGSLKPGVQGKKVRKPSSKGLACGSKEAKDLKARRKKSQDGKGCLLDSSGMLSPVDSLESPHGYLSDVASPPLLPSPFQQSPSVPLNHLPGMPDTHLGIGHLNVAAKPEMAALGGGGRLAFETGPPRLSHLPVASGTSTVLGSSSGGALNFTVGGSTSLNGQCEWLSRLQSGMVPNQYNPLRGSVAPGPLSTQAPSLQHGMVGPLHSSLAASALSQMMSYQGLPSTRLATQPHLVQTQQVQPQNLQMQQQNLQPANIQQQQSLQPPPPPPQPHLGVSSAASGHLGRSFLSGEPSQADVQPLGPSSLAVHTILPQESPALPTSLPSSLVPPVTAAQFLTPPSQHSYSSPVDNTPSHQLQVPEHPFLTPSPESPDQWSSSSPHSNVSDWSEGVSSPPTSMQSQIARIPEAFK

SEQ ID NO: 900 - protein, 2003 aa, Homo sapiens
  Notch-4 (Q99466)
MQPPSLLLLLLLLLLLCVSVVRPRGLLCGSFPEPCANGGTCLSLSLGQGTCQCAPGFLGETCQFPDPCQNAQLCQNGGSCQALLPAPLGLPSSPSPLTPSFLCTCLPGFTGERCQAKLEDPCPPSFCSKRGRCHIQASGRPQCSCMPGWTGEQCQLRDFCSANPCVNGGVCLATYPQIQCHCPPGFEGHACERDVNECFQDPGPCPKGTSCHNTLGSFQCLCPVGQEGPRCELRAGPCPPRGCSNGGTCQLMPEKDSTFHLCLCPPGFIGPDCEVNPDNCVSHQCQNGGTCQDGLDTYTCLCPETWTGWDCSEDVDECETQGPPHCRNGGTCQNSAGSFHCVCVSGWGGTSCEENLDDCIAATCAPGSTCIDRVGSFSCLCPPGRTGLLCHLEDMCLSQPCHGDAQCSTNPLTGSTLCLCQPGYSGPTCHQDLDECLMAQQGPSPCEHGGSCLNTPGSFNCLCPPGYTGSRCEADHNECLSQPCHPGSTCLDLLATFHCLCPPGLEGQLCEVETNECASAPCLNHADCHDLLNGFQCICLPGFSGTRCEEDIDECRSSPCANGGQCQDQPGAFHCKCLPGFEGPRCQTEVDECLSDPCPVGASCLDLPGAFFCLCPSGFTGQLCEVPLCAPNLCQPKQICKDQKDKANCLCPDGSPGCAPPEDNCTCHHGHCQRSSCVCDVGWTGPECEAELGGCISAPCAHGGTCYPQPSGYNCTCPTGYTGPTCSEEMTACHSGPCLNGGSCNPSPGGYYCTCPPSHTGPQCQTSTDYCVSAPCFNGGTCVNRPGTFSCLCAMGFQGPRCEGKLRPSCADSPCRNRATCQDSPQGPRCLCPTGYTGGSCQTLMDLCAQKPCPRNSHCLQTGPSFHCLCLQGWTGPLCNLPLSSCQKAALSQGIDVSSLCHNGGLCVDSGPSYFCHCPPGFQGSLCQDHVNPCESRPCQNGATCMAQPSGYLCQCAPGYDGQNCSKELDACQSQPCHNHGTCTPKPGGFHCACPPGFVGLRCEGDVDECLDQPCHPTGTAACHSLANAFYCQCLPGHTGQWCEVEIDPCHSQPCFHGGTCEATAGSPLGFICHCPKGFEGPTCSHRAPSCGFHHCHHGGLCLPSPKPGFPPRCACLSGYGGPDCLTPPAPKGCGPPSPCLYNGSCSETTGLGGPGFRCSCPHSSPGPRCQKPGAKGCEGRSGDGACDAGCSGPGGNWDGGDCSLGVPDPWKGCPSHSRCWLLFRDGQCHPQCDSEECLFDGYDCETPPACTPAYDQYCHDHFHNGHCEKGCNTAECGWDGGDCRPEDGDPEWGPSLALLVVLSPPALDQQLFALARVLSLTLRVGLWVRKDRDGRDMVYPYPGARAEEKLGGTRDPTYQERAAPQTQPLGKETDSLSAGFVVVMGVDLSRCGPDHPASRCPWDPGLLLRFLAAMAAVGALEPLLPGPLLAVHPHAGTAPPANQLPWPVLCSPVAGVILLALGALLVLQLIRRRRREHGALWLPPGFTRRPRTQSAPHRRRPPLGEDSIGLKALKPKAEVDEDGVVMCSGPEEGEEVGQAEETGPPSTCQLWSLSGGCGALPQAAMLTPPQESEMEAPDLDTRGPDGVTPLMSAVCCGEVQSGTFQGAWLGCPEPWEPLLDGGACPQAHTVGTGETPLHLAARFSRPTAARRLLEAGANPNQPDRAGRTPLHAAVAADAREVCQLLLRSRQTAVDARTEDGTTPLMLAARLAVEDLVEELIAAQADVGARDKWGKTALHWAAAVNNARAARSLLQAGADKDAQDNREQTPLFLAAREGAVEVAQLLLGLGAARELRDQAGLAPADVAHQRNHWDLLTLLEGAGPPEARHKATPGREAGPFPRARTVSVSVPPHGGGALPRCRTLSAGAGPRGGGACLQARTWSVDLAARGGGAYSHCRSLSGVGAGGGPTPRGRRFSAGMRGPRPNPAIMRGRYGVAAGRGGRVSTDDWPCDWVALGACGSASNIPIPPPCLTPSPERGSPQLDCGPPALQEMPINQGGEGKK

SEQ ID NO: 901 - DNA, 52 bp, Artificial Sequence
  Description of Artificial Sequence: Synthetic oligonucleotide
  DLL4 Egf2 reverse1
cagatcctcttctgagatgagtttttgttcgttgagatcttggtcacaaaac

SEQ ID NO: 902 - DNA, 5882 bp, Artificial Sequence
  Description of Artificial Sequence: Synthetic polynucleotide
  pGL4.26
ggcctaactggccggtacctgagctcgctagcctcgaggatatcaagatctggcctcggcggccaagcttagacactagagggtatataatggaagctcgacttccagcttggcaatccggtactgttggtaaagccaccatggaagatgccaaaaacattaagaagggcccagcgccattctacccactcgaagacgggaccgccggcgagcagctgcacaaagccatgaagcgctacgccctggtgcccggcaccatcgcctttaccgacgcacatatcgaggtggacattacctacgccgagtacttcgagatgagcgttcggctggcagaagctatgaagcgctatgggctgaatacaaaccatcggatcgtggtgtgcagcgagaatagcttgcagttcttcatgcccgtgttgggtgccctgttcatcggtgtggctgtggccccagctaacgacatctacaacgagcgcgagctgctgaacagcatgggcatcagccagcccaccgtcgtattcgtgagcaagaaagggctgcaaaagatcctcaacgtgcaaaagaagctaccgatcatacaaaagatcatcatcatggatagcaagaccgactaccagggcttccaaagcatgtacaccttcgtgacttcccatttgccacccggcttcaacgagtacgacttcgtgcccgagagcttcgaccgggacaaaaccatcgccctgatcatgaacagtagtggcagtaccggattgcccaagggcgtagccctaccgcaccgcaccgcttgtgtccgattcagtcatgcccgcgaccccatcttcggcaaccagatcatccccgacaccgctatcctcagcgtggtgccatttcaccacggcttcggcatgttcaccacgctgggctacttgatctgcggctttcgggtcgtgctcatgtaccgcttcgaggaggagctattcttgcgcagcttgcaagactataagattcaatctgccctgctggtgcccacactatttagcttcttcgctaagagcactctcatcgacaagtacgacctaagcaacttgcacgagatcgccagcggcggggcgccgctcagcaaggaggtaggtgaggccgtggccaaacgcttccacctaccaggcatccgccagggctacggcctgacagaaacaaccagcgccattctgatcacccccgaaggggacgacaagcctggcgcagtaggcaaggtggtgcccttcttcgaggctaaggtggtggacttggacaccggtaagacactgggtgtgaaccagcgcggcgagctgtgcgtccgtggccccatgatcatgagcggctacgttaacaaccccgaggctacaaacgctctcatcgacaaggacggctggctgcacagcggcgacatcgcctactgggacgaggacgagcacttcttcatcgtggaccggctgaagagcctgatcaaatacaagggctaccaggtagccccagccgaactggagagcatcctgctgcaacaccccaacatcttcgacgccggggtcgccggcctgcccgacgacgatgccggcgagctgcccgccgcagtcgtcgtgctggaacacggtaaaaccatgaccgagaaggagatcgtggactatgtggccagccaggttacaaccgccaagaagctgcgcggtggtgttgtgttcgtggacgaggtgcctaaaggactgaccggcaagttggacgcccgcaagatccgcgagattctcattaaggccaagaagggcggcaagatcgccgtgtaataattctagagtcggggcggccggccgcttcgagcagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtaaaatcgataaggatccgtttgcgtattgggcgctcttccgctgatctgcgcagcaccatggcctgaaataacctctgaaagaggaacttggttagctaccttctgaggcggaaagaaccagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcgattcttctgacactagcgccaccatgaagaagcccgaactcaccgctaccagcgttgaaaaatttctcatcgagaagttcgacagtgtgagcgacctgatgcagttgtcggagggcgaagagagccgagccttcagcttcgatgtcggcggacgcggctatgtactgcgggtgaatagctgcgctgatggcttctacaaagaccgctacgtgtaccgccacttcgccagcgctgcactacccatccccgaagtgttggacatcggcgagttcagcgagagcctgacatactgcatcagtagacgcgcccaaggcgttactctccaagacctccccgaaacagagctgcctgctgtgttacagcctgtcgccgaagctatggatgctattgccgccgccgacctcagtcaaaccagcggcttcggcccattcgggccccaaggcatcggccagtacacaacctggcgggatttcatttgcgccattgctgatccccatgtctaccactggcagaccgtgatggacgacaccgtgtccgccagcgtagctcaagccctggacgaactgatgctgtgggccgaagactgtcccgaggtgcgccacctcgtccatgccgacttcggcagcaacaacgtcctgaccgacaacggccgcatcaccgccgtaatcgactggtccgaagctatgttcggggacagtcagtacgaggtggccaacatcttcttctggcggccctggctggcttgcatggagcagcagactcgctacttcgagcgccggcatcccgagctggccggcagccctcgtctgcgagcctacatgctgcgcatcggcctggatcagctctaccagagcctcgtggacggcaacttcgacgatgctgcctgggctcaaggccgctgcgatgccatcgtccgcagcggggccggcaccgtcggtcgcacacaaatcgctcgccggagcgcagccgtatggaccgacggctgcgtcgaggtgctggccgacagcggcaaccgccggcccagtacacgaccgcgcgctaaggaggtaggtcgagtttaaactctagaaccggtcatggccgcaataaaatatctttattttcattacatctgtgtgttggttttttgtgtgttcgaactagatgctgtcgaccgatgcccttgagagccttcaacccagtcagctccttccggtgggcgcggggcatgactatcgtcgccgcacttatgactgtcttctttatcatgcaactcgtaggacaggtgccggcagcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagcggccgcaaatgctaaaccactgcagtggttaccagtgcttgatcagtgaggcaccgatctcagcgatctgcctatttcgttcgtccatagtggcctgactccccgtcgtgtagatcactacgattcgtgagggcttaccatcaggccccagcgcagcaatgatgccgcgagagccgcgttcaccggcccccgatttgtcagcaatgaaccagccagcagggagggccgagcgaagaagtggtcctgctactttgtccgcctccatccagtctatgagctgctgtcgtgatgctagagtaagaagttcgccagtgagtagtttccgaagagttgtggccattgctactggcatcgtggtatcacgctcgtcgttcggtatggcttcgttcaactctggttcccagcggtcaagccgggtcacatgatcacccatattatgaagaaatgcagtcagctccttagggcctccgatcgttgtcagaagtaagttggccgcggtgttgtcgctcatggtaatggcagcactacacaattctcttaccgtcatgccatccgtaagatgcttttccgtgaccggcgagtactcaaccaagtcgttttgtgagtagtgtatacggcgaccaagctgctcttgcccggcgtctatacgggacaacaccgcgccacatagcagtactttgaaagtgctcatcatcgggaatcgttcttcggggcggaaagactcaaggatcttgccgctattgagatccagttcgatatagcccactcttgcacccagttgatcttcagcatcttttactttcaccagcgtttcggggtgtgcaaaaacaggcaagcaaaatgccgcaaagaagggaatgagtgcgacacgaaaatgttggatgctcatactcgtcctttttcaatattattgaagcatttatcagggttactagtacgtctctcaaggataagtaagtaatattaaggtacgggaggtattggacaggccgcaataaaatatctttattttcattacatctgtgtgttggttttttgtgtgaatcgatagtactaacatacgctctccatcaaaacaaaacgaaacaaaacaaactagcaaaataggctgtccccagtgcaagtgcaggtgccagaacatttctct

SEQ ID NO: 903 - DNA, 4188 bp, Artificial Sequence
  Description of Artificial Sequence: Synthetic polynucleotide
  pFUSE-hlgG2-Fc2
ggatctgcgatcgctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagctgaagcttcgaggggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctacgtctttgtttcgttttctgttctgcgccgttacagatccaagctgtgaccggcgcctacctgagatcaccggcgaaggagggccaccatgtacaggatgcaactcctgtcttgcattgcactaagtcttgcacttgtcacgaattcgatatcggccatggttagatctgtggagtgcccaccttgcccagcaccacctgtggcaggaccttcagtcttcctcttccccccaaaacccaaggacaccctgatgatctccagaacccctgaggtcacgtgcgtggtggtggacgtgagccacgaagaccccgaggtccagttcaactggtacgtggacggcatggaggtgcataatgccaagacaaagccacgggaggagcagttcaacagcacgttccgtgtggtcagcgtcctcaccgtcgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacacagaagagcctctccctgtctccgggtaaatgagtgccacggctagctggccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtatggaattaattctaaaatacagcatagcaaaactttaacctccaaatcaagcctctacttgaatccttttctgagggatgaataaggcataggcatcaggggctgttgccaatgtgcattagctgtttgcagcctcaccttctttcatggagtttaagatatagtgtattttcccaaggtttgaactagctcttcatttctttatgttttaaatgcactgacctcccacattccctttttagtaaaatattcagaaataatttaaatacatcattgcaatgaaaataaatgttttttattaggcagaatccagatgctcaaggcccttcataatatcccccagtttagtagttggacttagggaacaaaggaacctttaatagaaattggacagcaagaaagcgagcttctagcttatcctcagtcctgctcctctgccacaaagtgcacgcagttgccggccgggtcgcgcagggcgaactcccgcccccacggctgctcgccgatctcggtcatggccggcccggaggcgtcccggaagttcgtggacacgacctccgaccactcggcgtacagctcgtccaggccgcgcacccacacccaggccagggtgttgtccggcaccacctggtcctggaccgcgctgatgaacagggtcacgtcgtcccggaccacaccggcgaagtcgtcctccacgaagtcccgggagaacccgagccggtcggtccagaactcgaccgctccggcgacgtcgcgcgcggtgagcaccggaacggcactggtcaacttggccatgatggctcctcctgtcaggagaggaaagagaagaaggttagtacaattgctatagtgagttgtattatactatgcagatatactatgccaatgattaattgtcaaactagggctgcagggttcatagtgccacttttcctgcactgccccatctcctgcccaccctttcccaggcatagacagtcagtgacttaccaaactcacaggagggagaaggcagaagcttgagacagacccgcgggaccgccgaactgcgaggggacgtggctagggcggcttcttttatggtgcgccggccctcggaggcagggcgctcggggaggcctagcggccaatctgcggtggcaggaggcggggccgaaggccgtgcctgaccaatccggagcacataggagtctcagccccccgccccaaagcaaggggaagtcacgcgcctgtagcgccagcgtgttgtgaaatgggggcttgggggggttggggccctgactagtcaaaacaaactcccattgacgtcaatggggtggagacttggaaatccccgtgagtcaaaccgctatccacgcccattgatgtactgccaaaaccgcatcatcatggtaatagcgatgactaatacgtagatgtactgccaagtaggaaagtcccataaggtcatgtactgggcataatgccaggcgggccatttaccgtcattgacgtcaatagggggcgtacttggcatatgatacacttgatgtactgccaagtgggcagtttaccgtaaatactccacccattgacgtcaatggaaagtccctattggcgttactatgggaacatacgtcattattgacgtcaatgggcgggggtcgttgggcggtcagccaggcgggccatttaccgtaagttatgtaacgcctgcaggttaattaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatggctagttaattaacatttaaatcagcggccgcaataaaatatctttattttcattacatctgtgtgttggttttttgtgtgaatcgtaactaacatacgctctccatcaaaacaaaacgaaacaaaacaaactagcaaaataggctgtccccagtgcaagtgcaggtgccagaacatttctctatcgaa

SEQ ID NO: 904 - protein, 10 aa, Artificial Sequence
  Description of Artificial Sequence: Synthetic peptide
  CDRH1
GYTFTSYVIN

SEQ ID NO: 905 - protein, 4 aa, Homo sapiens
MNNL

SEQ ID NO: 906 - protein, 6 aa, Artificial Sequence
  Description of Artificial Sequence: Synthetic 6xHis tag
HHHHHH

What is claimed:

1. An isolated antibody or antigen-binding fragment thereof that specifically binds to human DLL4, wherein the antibody comprises at least one heavy chain variable domain and at least one light chain variable domain, wherein each heavy chain variable domain comprises three complementary determining regions (CDRs), CDRH1, CDRH2, and CDRH3, and each light chain variable domain comprises three CDRs, CDRL1, CDRL2, and CDRL3, wherein:

a) CDRH3 has an amino acid sequence selected from the group consisting of EEYSSSSAEYFQH (SEQ ID NO:851), RGYSYGYDYFDY (SEQ ID NO:852), EYYDFWSGYYTDYFDY (SEQ ID NO:853), EGYSSSWYDYFDY (SEQ ID NO:854), ANWGDYFDY (SEQ ID NO:855), DDYGGNSDYFDY (SEQ ID NO:856), EGYCSGGSCYS (SEQ ID NO:857), EYYYGSGSYYNDYFDY (SEQ ID NO:858), GCYCSSTSCYADYYYYYGMDV (SEQ ID NO:859), GSCYSYWYFDL (SEQ ID NO:860), SEQ ID NO:851 except that the amino acid residue at position(s) E96, Y97, S98, S99, S100, S100a, A100b, E100c, Q101, and/or H102 is different than the corresponding residue in SEQ ID NO: 851, wherein the different amino acid residue in SEQ ID NO: 851 is E96A, Y97A, S98A, S98Q, S98V, S98I, S98G, S99P, S99A, S99L, S99W, S99F, S99N, S99H, S99C, S99G, S100F, S100A, S100G, S100C, S100H, S100L, S100R, S100aA, A100bE, E100cA, Q101A, H102A, H102S, H102F, and/or H102Y, and SEQ ID NO: 852 except that the amino acid residue at position(s) R95, G96, Y97, S98, Y99, G100, Y100a, D100b, and/or D101 is different than the corresponding residue in SEQ ID NO: 852, wherein the different amino acid residue in SEQ ID NO: 852 is R95A, G96K, G96R, G96L, G96D, G96T, Y97A, Y97H, S98A, Y99A, G100A, G100D, G100L, G100P, G100R, G100M, G100K, G100S, G100R, G100T, Y100aA, D100bA, and/or D101A;

b) CDRH2 has an amino acid sequence selected from the group consisting of IINPSGGSTSYAQKFQG (SEQ ID NO:844), IIYPGDSDTRYSPSFQG (SEQ ID NO:845), RTYYRSKWYNDYAVSVKS (SEQ ID NO:846), EINHSGSTNYNPSLKS (SEQ ID NO:847), INSNAGNGNTKYSQEFQG (SEQ ID NO: 848), WMNPNSGNTGYAQKFQG (SEQ ID NO:849), YIYYSGSTYYNPSLKS (SEQ ID NO:850), SEQ ID NO: 844 except that the amino acid residue at position(s) I50, I51, N52, P52a, S53, G54, G55, G56, T57, and/or S58 is different than the corresponding residue in SEQ ID NO: 844, wherein the different amino acid residue in SEQ ID NO: 844 is I50A, I50T, I51A, I51T, I51V, I51N, I51R, I51W, I51S, I51G, I51V, I51E, I51H, I51Y, N52A, N52V, N52G, N52T, N52P, N52L, N52W, N52Y, N52V, N52S, N52Q, N52K, P52aA, P52aM, P52aE, P52aH, P52aY, P52aT, P52aN, P52aR, P52aW, P52aS, P52aG, S53A, S53I, S53E, S53R, S53G, S53T, S53L, S53V, S53N, S53P, G54A, G54W, G54D, G55A, G55V, G55E, G55S, G55K, G55T, G55L, G55R, G55H, G55I, G55W, S58A, T57A, and/or S58A, and SEQ ID NO: 845 except that the amino acid residue at position(s) I50, I51, Y52, P52a, D54, S55, D56 and/or T57 is different than the corresponding residue in SEQ ID NO: 845, wherein the different amino acid residue in SEQ ID NO: 845 is I50A, I51A, Y52A, P52aA, D54A, S55G, D56A, T57D, and/or T57A;

c) CDRH1 has an amino acid sequence selected from the group consisting of GYTFTSYYMH (SEQ ID NO: 830), GYSFTSYWIG (SEQ ID NO:831), GDSVSSNSAA (SEQ ID NO:832), GGSFSGYYWS (SEQ ID NO:833), GYTFTSYAMH (SEQ ID NO:834), GYTFTSYAIN (SEQ ID NO:835), GGSISSGGYY (SEQ ID NO:836), SEQ ID NO: 830 except that the amino acid residue at position(s) T28, F29, T30, S31, and/or Y33 is different than the corresponding residue in SEQ ID NO:830, wherein the different amino acid residue in SEQ ID NO: 830 is T28A, F29A, T30A, S31A, and/or Y33A, and SEQ ID NO: 831 except that the amino acid residue at position(s) S28, F29, T30, W33, I34, and/or G35 is different than the corresponding residue in SEQ ID NO: 831, wherein the different amino acid residue in SEQ ID NO: 831 is S28A, S28R, S28K, S28N, F29A, T30A, W33A, I34A, G35T, G35A, and/or G35V;

d) CDRL3 has an amino acid sequence selected from the group consisting of QQRSNWPPWT (SEQ ID NO:881), VLYMGSGISYV (SEQ ID NO:882), MIWH-SSASFV (SEQ ID NO: 883), QQYNNWPPWT (SEQ ID NO: 884), QANSFPPWT (SEQ ID NO:885), QQYGSSPPWT (SEQ ID NO: 886), QQYNSYSPWT (SEQ ID NO:887), MQRIEFPSWT (SEQ ID NO: 888), SSYTSSSTLFV (SEQ ID NO: 889), QVYESSANFV (SEQ ID NO: 890), SEQ ID NO: 881 except that the amino acid residue at position(s) R91, S92, N93, and/or W94 is different than the corresponding amino acid residue in SEQ ID NO: 881, wherein the different amino acid residue in SEQ ID NO: 881 is R91P, R91L, R91G, S92P, S92A, S92Q, S92V, S92T, S92R, S92G, S92V, S92M, S92N, S92C, N93Y, N93S, N93H, N93Q, W94R, W94S, W94T, W94L, W94P, and/or W94M, and SEQ ID NO: 882 except that the amino acid residue at position(s) V89, L90, Y91, M92, G93, S94, G95, I95a, and/or S95b is different than the corresponding amino acid residue in SEQ ID NO: 882, wherein the different amino acid residue in SEQ ID NO: 882 is V89A, V89P, V89T, V89S, V89L, V89R, V89C, V89E, V89W, V89N, V89I, V89G, V89H, L90A, Y91A, M92A, M92E, M92S, M92G, M92L, M92P, M92V, M92D, M92R, M92N, M92T, M92F, G93A, S94A, S94W, S94G, S94P, S94R, S94L, S94M, S94E, S94V, G94A, I95aA, and/or S95bA;

e) CDRL2 has an amino acid sequence selected from the group consisting of DASNRAT (SEQ ID NO:871), STNTRSS (SEQ ID NO: 872), YYSDSSK (SEQ ID NO:873), GASTRAT (SEQ ID NO:874), AASSLQS (SEQ ID NO:875), GASSRAT (SEQ ID NO: 876), DASSLGS (SEQ ID NO:877), TLSYRAS (SEQ ID NO:878), EVSNRPS (SEQ ID NO:879), HYSDSDK (SEQ ID NO:880), SEQ ID NO: 871 except that the amino acid residue at position(s) D50, A51, S52, N53, R54, A55, and/or T56 is different than the corresponding residue in SEQ ID NO: 871, wherein the different amino acid residue in SEQ ID NO: 871 is D50A, A51T, S52A, S52L, S52T, S52R, S52S, S52W, S52N, S52P, S52M, N53A, N53E, N53G, N53M, N53C, N53H, N53P, R54A, A55T, A55R, A55C, A55S, A55G, and/or T56A, and SEQ ID NO: 872 except that the amino acid residue at position(s) S50, T51, N52, T53, R54, S55, and/or S56 is different than the corresponding residue in SEQ ID NO: 872, wherein the different amino acid residue in SEQ ID NO: 872 is S50A, S50F, S50G, S50C, S50R, S50L, S50M, S50V, S50P, S50T, S50H, S50Q, S50N, S50K, S50D, S50E, S50W, T51A, T51F, T51L, T51I, T51M, T51V, T51S, T51P, T51Y, T51H, T51Q, T51N, T51K, T51D, T51E, T51W, T51R, T51G, N52A T53A, R54A, R54I, R54Y, R54D, R54G, S55A, S55F, S55L, S55I, S55M, S55V, S55P, S55T, S55Y, S55H, S55Q, S55N, S55K, S55D, S55E, S55W, S55R, S55G, and/or S56A; and f) CDRL1 has an amino acid sequence selected from the group consisting of RASQSVSSYLA (SEQ ID NO: 861), GLSSGSVSTSYYPS (SEQ ID NO:862), TLRS-GINLGSYRIF (SEQ ID NO:863), RASQSVSSNLA (SEQ ID NO:864), RASQGISSWLA (SEQ ID NO:865), RASQVSSSYLA (SEQ ID NO:866), RASQ-SISSWLA (SEQ ID NO:867), RSSQSLLDSDDGN-TYLD (SEQ ID NO:868), TGTSSDVGGTNYVS (SEQ ID NO:869), TLSSDLSVGGKNMF (SEQ ID NO:870), SEQ ID NO: 861 except that the amino acid residue at position(s) R24, Q27, S28, S30, S31, and/or Y32 is different than the corresponding residue in SEQ ID NO: 861, wherein the different amino acid residue in SEQ ID NO: 861 is R24G, Q27L, S28P, S28G, S28K, S28V, S28F, S28P, S28T, S28L, S28Q, S28A, S28N, S28H, S28I, S28R, S28W, S28M S28E, S30N, S30W, S30R, S30L, S30O, S30D, S30L, S30T, S30P, S30Y, S30Q, S30A, S30G, S30V, S31K, S31T, S31N, S31K, S31L, S31M, S31F, S31I, S31V, S31H, S31A, S31P, S31D, S31R, S31Y, S31Q, S31E, S31G, Y32V, and/or Y32S, and SEQ ID NO: 862 except that the amino acid residue at position(s) G24, L25, S26, S27, G27a, S27b, V27c, S28, T29, S30, Y31, Y32, and/or P33 is different than the corresponding residue in SEQ ID NO: 862, wherein the different amino acid residue in SEQ ID NO: 862 is G24A, G24R, G24L, L25A, S26A, S27A, G27aA, S27bA, V27cA, S28A, T29A, S30A, Y31A, Y32A, and/or P33A;

wherein the antibody or antigen-binding fragment optionally is isolated.

2. An antibody or antigen-binding fragment according to claim 1 that is a full-length antibody, optionally a full-length IgG antibody, or an antibody fragment, optionally an antibody fragment selected from the group consisting of a Fab, Fab', F(ab')$_2$, single-chain Fv (scFv), Fv, dsFv, diabody, Fd and Fd' fragment, Fab fragment, Fd fragment, scFv fragment, and a scFab fragment.

3. An antibody or antigen-binding fragment according to claim 1, wherein:

a) CDRH2 has the amino acid sequence of SEQ ID NO: 844 except for one of the following sets of differences, I51V/N52L/S53T/G55H, N52L/S53T/G55H, I51E/N52L/S53T/G55H, or I51N/N52L/S53T/G55H; or b) CDRH3 has the amino acid sequence of SEQ ID NO: 851 except for one of the following sets of differences, S98A/S99P/S100F, S98A/S99P/S100F/H102F, or S98A/S99P/S100F/H102Y; or c) CDRH3 has the amino acid sequence of SEQ ID NO: 852 except for the following differences, G96K/G100T; and/or d) CDRL1 has the amino acid sequence of SEQ ID NO: 861 except for the following differences, S28N/S30D/S31H; or e) CDRL2 has the amino acid sequence of SEQ ID NO: 871 except for one of the following sets of differences, S52L/A55S or S52L/A55G; or f) CDRL3 has the amino acid sequence of SEQ ID NO: 882 except for one of the following sets of differences, M92R/S94M or V89L/S94P.

4. An antibody or antigen-binding fragment according to claim 1 that comprises:

a) a CDRH2 having the amino acid sequence of SEQ ID NO: 844 except for the difference G55H and a CDRH3 having the amino acid sequence of SEQ ID NO: except for the differences S98A/S99P/S100F/H102F; or b) a CDRH3 having the amino acid sequence of SEQ ID NO:851 except for the differences S98A/S99P/S100F/H102F and a CDRL1 having the amino acid sequence of SEQ ID NO: 861 except for the differences S28N/S30D/S31H; or c) a CDRH2 having the amino acid sequence of SEQ ID NO:844 except for the differences I51V/N52L/S53T/

G55H, a CDRH3 having the amino acid sequence of SEQ ID NO:851 except for the differences S98A/S99P/S100F/H102F, and a CDRL1 having the amino acid sequence of SEQ ID NO: 861 except for the differences S28N/S30D/S31H; or
d) a CDRH2 having the amino acid sequence of SEQ ID NO:844 except for the differences I51/N52L/S53T/G55H, a CDRH3 having the amino acid sequence of SEQ ID NO:851 except for the differences S98A/S99P/S100F/H102F, a CDRL1 having the amino acid sequence of SEQ ID NO: 861 except for the differences S28N/S30D/S31H, and a CDRL2 having the amino acid sequence of SEQ ID NO:871 except for the differences S52L/A55S; or
e) a CDRH1 having the amino acid sequence of SEQ ID NO:831 except for the differences S28R/G35V, a CDRH3 having the amino acid sequence of SEQ ID NO:852 except for the differences G96K/G100T, and a CDRL3 having the amino acid sequence of SEQ ID NO:882 except for the differences M92R/S94M; or
f) a CDRH1 having the amino acid sequence of SEQ ID NO:831 except for the differences S28R/G35V, a CDRH3 having the amino acid sequence of SEQ ID NO:852 except for the differences G96K/G100T, and a CDRL3 having the amino acid sequence of SEQ ID NO:882 except for the differences V89L/S94P; or
g) a CDRH1 having the amino acid sequence of SEQ ID NO:831 except for the differences S28R/G35V, a CDRH3 having the amino acid sequence of SEQ ID NO:852 except for the differences G96K/G100T, a CDRL2 having the amino acid sequence of SEQ ID NO:872 except for the differences S50G, and a CDRL3 having the amino acid sequence of SEQ ID NO:882 except for the differences V89L/S94P; or
h) a CDRH2 comprising the amino acid sequence of SEQ ID NO:844 except for the differences I51V/N52L/S53T/G55H, a CDRH3 comprising the amino acid sequence of SEQ ID NO:851 except for the differences S98A/S99P/S100F/H102F, a CDRL1 comprising the amino acid sequence of SEQ ID NO: 861 except for the differences S28N/S30D/S31H, and a CDRL2 comprising the amino acid sequence of SEQ ID NO:871 except for the differences S52L/A55G.

5. An antibody or antigen-binding fragment according to claim 1 that exhibits at least a binding affinity that is $10^{-6}$ M, $10^{-7}$ M, $10^{-8}$ M, $10^{-9}$ M, $10^{-10}$ M, $10^{-11}$ M, or $10^{-12}$ M or lower as measured by surface plasmon resonance (SPR).

6. An antibody or antigen-binding fragment according to claim 1 that is germline-derived, wherein the antibody or antigen-binding fragment optionally comprises:
A. a heavy chain variable domain comprising $V_H$, $D_H$, and $J_H$ germline segments or modified germline segments and a light chain variable domain comprising $V_\kappa$, and $J_\kappa$ or $V_\lambda$ and $J_\lambda$ germline segments, wherein:
a) the $V_H$ germline segment is an IGHV1, an IGHV4, an IGHV5, or an IGHV6 germline segment or allelic variant thereof, optionally an IGHV1-3*01, an IGHV1-3*02, an IGHV1-8*01, an IGHV1-46*01, an IGHV1-46*02, an IGHV1-46*03, an IGHV4-31*01, an IGHV4-31*02, an IGHV4-31*03, an IGHV4-31*04, an IGHV4-31*05, an IGHV4-31*06, an IGHV4-31*07, an IGHV4-31*08, an IGHV4-31*09, an IGHV4-31*10, an IGHV4-34*01, an IGHV4-34*02, an IGHV4-34*03, an IGHV4-34*04, an IGHV4-34*05, an IGHV4-34*06, an IGHV4-34*07, an IGHV4-34*08, an IGHV4-34*09, an IGHV4-34*10, an IGHV4-34*11, an IGHV4-34*12, an IGHV4-34*13, an IGHV5-51*01, an IGHV5-51*02, an IGHV5-51*03, an IGHV5-51*04, an IGHV5-51*05, an IGHV6-1*01, or an IGHV6-1*02 germline segment or a modification or optimized derivative thereof; and
b) the $D_H$ germline segment is an IGHD6, an IGHD5, an IGHD4, an IGHD2, an IGHD3, or an IGHD7 germline segment or allelic variant thereof, optionally an IGHD2-2*01, an IGHD2-2*02, an IGHD2-15*01, an IGHD4-23*01, an IGHD6-6*01, an IGHD6-13*01, IGHD5-18*01, IGHD3-3*01, an IGHD3-3*02, an IGHD3-10*01, an IGHD3-10*02, or an IGHD7-27*01 germline segment or a modification or optimized derivative thereof; and
c) the $J_H$ germline segment is an IGHJ1, an IGHJ2, an IGHJ4, or an IGHJ6 germline segment or allelic variant thereof, optionally an IGHJ1*01, an IGHJ2*01, an IGHJ4*01, an IGHJ4*02, an IGHJ4*03, an IGHJ6*01, an IGHJ6*02, an IGHJ6*03, or an IGHJ6*04 germline segment or a modification or optimized derivative thereof; and
d) the $V_\kappa$ germline segment is an IGKV1, an IGKV2, or an IGKV3 germline segment or allelic variant thereof and the $J_\kappa$ is a IGKJ1 germline segment or allelic variant thereof, optionally an IGKV1-5*01, an IGKV1-5*02, an IGKV1-5*03, an IGKV1-12*01, an IGKV1-12*02, an IGKV2-D-40*01, an IGKV3-11*01, an IGKV3-11*02, an IGKV3-15*01, an IGKV3-20*01, or an IGKV3-20*02 germline segment or a modification or optimized derivative thereof and an IGKJ1*01 germline segment or a modification or optimized derivative thereof; or
e) the $V_\lambda$ germline segment is an IGLV2, an IGLV8, an IGLV11, or an IGLV5 germline segment or allelic variant thereof and the $J_\lambda$ germline segment is an IGLJ1 or an IGLJ4 germline segment or allelic variant thereof, optionally an IGLV2-14*01, an IGLV2-14*02, an IGLV2-14*03, an IGLV2-14*04, an IGLV8-61*01, an IGLV8-61*02, an IGLV8-61*03, an IGLV5-48*01, or an IGLV11-55*01 germline segment or a modification or optimized derivative thereof and an IGLJ1*01 or IGLJ4*01 germline segment or a modification or optimized derivative thereof; and/or
B. a heavy chain variable domain comprising $V_H$, $D_H$, and $J_H$ germline segments or modified germline segments and a light chain variable domain comprising $V_\kappa$ and $J_\kappa$ or $V_\lambda$ and $J_\lambda$ germline segments, wherein:
a) the heavy chain variable domain comprises IGHV1-46*01, an IGHD6-6*01, and an IGHJ1*01 germline segments or modified forms thereof and the light chain variable domain comprises IGKV3-11*01 and IGKJ1*01 germline segments or modified forms thereof; or
b) the heavy chain variable domain comprises IGHV5-51*03, IGHD5-18*01, and IGHJ4*01 germline segments or modified forms thereof and the light chain variable domain comprises IGLV8-61*01 and IGLJ1*01 germline segments or modified forms thereof; or
c) the heavy chain variable domain comprises IGHV6-1*01, IGHD3-3*01, and IGHJ4*01 germline segments or modified forms thereof and the light chain variable domain comprises IGLV5-48*01 and IGLJ4*01 germline segments or a modified forms thereof; or
d) the heavy chain variable domain comprises IGHV1-46*01, IGHD6-13*01, and IGHJ4*01 germline segments or modified forms thereof and the light chain variable domain comprises IGKV3-15*01 and IGKJ1*01 germline segments or modified forms thereof; or e) the heavy chain variable domain comprises IGHV4-34*01, IGHD7-27*01, and IGHJ4*01 germline segments or modified forms thereof and the light chain variable domain comprises IGKV1-12*01 and IGKJ1*01 germline segments or modified forms thereof; or f) the heavy chain variable domain comprises IGHV1-46*01, IGHD6-13*01, and IGHJ4*01 germline segments or modified forms thereof and the light chain variable domain comprises IGKV3-20*01 and IGKJ1*01 germline segments or modified forms thereof; or g) the heavy chain variable domain comprises IGHV1-3*02, IGHD4-23*01, and IGHJ4*01 germline segments or modified forms thereof and the light chain variable domain comprises IGKV1-5*01 and IGKJ1*01 germline segments or modified forms thereof; or h) the heavy chain variable domain comprises IGHV1-46*01, IGHD2-15*01, and IGHJ2*01 germline segments or modified forms thereof and the light chain variable domain comprises IGKV1-5*01 and IGKJ1*01 germline segments or modified forms thereof; or i) the heavy chain variable domain comprises IGHV1-46*01, IGHD3-10*01, and IGHJ4*01 germline segments or modified forms thereof and the light chain variable domain comprises IGKV1-5*01 and IGKJ1*01 germline segments or modified forms thereof; or j) the heavy chain variable domain comprises IGHV1-8*01, IGHD2-2*01, and IGHJ6*01 germline segments or modified forms thereof and the light chain variable domain comprises IGKV1-5*01 and IGKJ1*01 germline segments or modified forms thereof; or k) the heavy chain variable domain comprises IGHV1-46*01, IGHD6-13*01, and IGHJ4*01 germline segments or modified forms thereof and the light chain variable domain comprises IGKV2D-40*01 and, IGKJ1*01 germline segments or modified forms thereof; or l) the heavy chain variable domain comprises IGHV4-34*01, IGHD7-27*01, and IGHJ4*01 germline segments or modified forms thereof and the light chain variable domain comprises IGLV2-14*01 and IGLJ4*01 germline segments or modified forms thereof; or m) the heavy chain variable domain comprises IGHV4-31*02, IGHD2-15*01, and IGHJ2*01 germline segments or modified forms thereof and the light chain variable domain comprises IGLV2-14*01 and IGLJ4*01 germline segments or modified forms thereof; or n) the heavy chain variable domain comprises IGHV4-34*01, IGHD7-27*01, and IGHJ4*01 germline segments or modified forms thereof and the light chain variable domain comprises IGLV11-55*01 and IGLJ4*01 germline segments or a modified form thereof; and/or C. a heavy chain variable domain comprising $V_H$, $D_H$, and $J_H$ germline segments or modified germline segments and a light chain variable domain comprising $V_\kappa$ and $J_\kappa$ or $V_\lambda$ and $J_\lambda$ germline segments, wherein:

a) the heavy chain variable domain comprises an amino acid sequence of SEQ ID NO: 131 and the light chain variable domain comprises an amino acid sequence of SEQ ID NO:141; or b) the heavy chain variable domain comprises an amino acid sequence of SEQ ID NO: 132 and the light chain variable domain comprises an amino acid sequence of SEQ ID NO:142; or c) the heavy chain variable domain comprises an amino acid sequence of SEQ ID NO: 133 and the light chain variable domain comprises an amino acid sequence of SEQ ID NO:143; or d) the heavy chain variable domain comprises an amino acid sequence of SEQ ID NO: 135 and the light chain variable domain comprises an amino acid sequence of SEQ ID NO:145; or e) the heavy chain variable domain comprises an amino acid sequence of SEQ ID NO: 137 and the light chain variable domain comprises an amino acid sequence of SEQ ID NO:146; or f) the heavy chain variable domain comprises an amino acid sequence of SEQ ID NO: 135 and the light chain variable domain comprises an amino acid sequence of SEQ ID NO:144; or g) the heavy chain variable domain comprises an amino acid sequence of SEQ ID NO: 138 and the light chain variable domain comprises an amino acid sequence of SEQ ID NO:147; or h) the heavy chain variable domain comprises an amino acid sequence of SEQ ID NO: 136 and the light chain variable domain comprises an amino acid sequence of SEQ ID NO:147; or i) the heavy chain variable domain comprises an amino acid sequence of SEQ ID NO: 134 and the light chain variable domain comprises an amino acid sequence of SEQ ID NO:147; or j) the heavy chain variable domain comprises an amino acid sequence of SEQ ID NO: 139 and the light chain variable domain comprises an amino acid sequence of SEQ ID NO:147; or k) the heavy chain variable domain comprises an amino acid sequence of SEQ ID NO: 135 and the light chain variable domain comprises an amino acid sequence of SEQ ID NO:148; or l) the heavy chain variable domain comprises an amino acid sequence of SEQ ID NO: 137 and the light chain variable domain comprises an amino acid sequence of SEQ ID NO:149; or m) the heavy chain variable domain comprises an amino acid sequence of SEQ ID NO: 140 and the light chain variable domain comprises an amino acid sequence of SEQ ID NO:149; or n) the heavy chain variable domain comprises an amino acid sequence of SEQ ID NO: 137 and the light chain variable domain comprises an amino acid sequence of SEQ ID NO:150; or D. a heavy chain variable domain comprising $V_H$, $D_H$, and $J_H$ germline segments or modified germline segments and a light chain variable domain comprising $V_\kappa$ and $J_\kappa$ or $V_\lambda$ and $J_\lambda$ germline segments, wherein:

a) the heavy chain variable domain comprises an amino acid sequence of SEQ ID NO: 155 and the light chain variable domain comprises an amino acid sequence of SEQ ID NO:141; or b) the heavy chain variable domain comprises an amino acid sequence of SEQ ID NO: 156 and the light chain variable domain comprises an amino acid sequence of SEQ ID NO:141; or
c) the heavy chain variable domain comprises an amino acid sequence of SEQ ID NO: 385 and the light chain variable domain comprises an amino acid sequence of SEQ ID NO:142; or E. a heavy chain variable domain comprising $V_H$, $D_H$, and $J_H$ germline segments or modified germline segments and a light chain variable domain comprising $V_\kappa$ and $J_\kappa$ or $V_\lambda$ and $J_\lambda$ germline segments, wherein:
  a) the heavy chain variable domain comprises an amino acid sequence of SEQ ID NO: 384 and the light chain variable domain comprises an amino acid sequence of SEQ ID NO:142; or
  b) the heavy chain variable domain comprises an amino acid sequence of SEQ ID NO: 414 and the light chain variable domain comprises an amino acid sequence of SEQ ID NO:142; or
  c) the heavy chain variable domain comprises an amino acid sequence of SEQ ID NO: 433 and the light chain variable domain comprises an amino acid sequence of SEQ ID NO:142; or
  d) the heavy chain variable domain comprises an amino acid sequence of SEQ ID NO: 433 and the light chain variable domain comprises an amino acid sequence of SEQ ID NO:479; or
  e) the heavy chain variable domain comprises an amino acid sequence of SEQ ID NO: 433 and the light chain variable domain comprises an amino acid sequence of SEQ ID NO:537; or
  f) the heavy chain variable domain comprises an amino acid sequence of SEQ ID NO: 433 and the light chain variable domain comprises an amino acid sequence of SEQ ID NO:536; or
  g) the heavy chain variable domain comprises an amino acid sequence of SEQ ID NO: 131 and the light chain variable domain comprises an amino acid sequence of SEQ ID NO:141; or
  h) the heavy chain variable domain comprises an amino acid sequence of SEQ ID NO: 151 and the light chain variable domain comprises an amino acid sequence of SEQ ID NO:141; or
  i) the heavy chain variable domain comprises an amino acid sequence of SEQ ID NO: 155 and the light chain variable domain comprises an amino acid sequence of SEQ ID NO:141; or
  j) the heavy chain variable domain comprises an amino acid sequence of SEQ ID NO: 156 and the light chain variable domain comprises an amino acid sequence of SEQ ID NO:141; or
  k) the heavy chain variable domain comprises an amino acid sequence of SEQ ID NO: 157 and the light chain variable domain comprises an amino acid sequence of SEQ ID NO:141; or
  l) the heavy chain variable domain comprises an amino acid sequence of SEQ ID NO: 155 and the light chain variable domain comprises an amino acid sequence of SEQ ID NO:266; or
  m) the heavy chain variable domain comprises an amino acid sequence of SEQ ID NO: 219 and the light chain variable domain comprises an amino acid sequence of SEQ ID NO:141; or
  n) the heavy chain variable domain comprises an amino acid sequence of SEQ ID NO: 156 and the light chain variable domain comprises an amino acid sequence of SEQ ID NO:343; or
  o) the heavy chain variable domain comprises an amino acid sequence of SEQ ID NO: 239 and the light chain variable domain comprises an amino acid sequence of SEQ ID NO:343; or
  p) the heavy chain variable domain comprises an amino acid sequence of SEQ ID NO: 239 and the light chain variable domain comprises an amino acid sequence of SEQ ID NO:370; or
  q) the heavy chain variable domain comprises an amino acid sequence of SEQ ID NO: 134 and the light chain variable domain comprises an amino acid sequence of SEQ ID NO:147; or F. a heavy chain variable domain comprising an amino acid sequence of SEQ ID NO: 433 and a light chain variable domain comprising an amino acid sequence of SEQ ID NO:537; or
G. a heavy chain variable domain comprising an amino acid sequence of SEQ ID NO: 433 and a light chain variable domain comprising an amino acid sequence of SEQ ID NO:536; or
H. a heavy chain variable domain comprising an amino acid sequence of SEQ ID NO: 239 and a light chain variable domain comprising an amino acid sequence of SEQ ID NO:343; or
I. a heavy chain variable domain comprising an amino acid sequence of SEQ ID NO: 239 and a light chain variable domain comprising an amino acid sequence of SEQ ID NO:370; or
J. a heavy chain variable domain comprising an amino acid sequence of SEQ ID NO: 240 and a light chain variable domain comprising an amino acid sequence of SEQ ID NO:369; or
K. a heavy chain variable domain comprising an amino acid sequence of SEQ ID NO: 240 and a light chain variable domain comprising an amino acid sequence of SEQ ID NO:370.

7. An antibody or antigen-binding fragment according to claim 1, wherein the antibody or antigen-binding fragment (i) exhibits affinity for human DLL4 expressed on the surface of a cell, optionally on the surface of an endothelial cell, and/or (ii) modulates an activity of human DLL4, optionally as an agonist or antagonist, wherein such modulation optionally comprises inhibiting Notch activation.

8. An antibody or antigen-binding fragment according to claim 1, wherein the antibody or antigen-binding fragment specifically binds to an epitope within an EGF domain of DLL4, optionally within the EGF2 to EGF4 domains of DLL4, optionally within the EGF3 to EGF4 domain or in EGF2 domain of DLL4.

9. An antibody or antigen-binding fragment according to claim 1, wherein the antibody or antigen-binding fragment specifically binds to a human DLL4 epitope within amino acids 283 to 360 of human DLL4 set forth in SEQ ID NO:114, wherein the antibody or antigen-binding fragment comprises:
  A. at least one heavy chain variable domain and at least one light chain variable domain, wherein:
    a) each heavy chain variable domain comprises (i) a CDRH1 having an amino acid sequence GYSFTSYWIG (SEQ ID NO:831); (ii) a CDRH2 having an amino acid sequence IIYPGDSDTRYSPSFQG (SEQ ID NO:845); and (iii) a CDRH3 having an amino acid sequence RGYSYGYDYFDY (SEQ ID NO:852); and b) each light chain variable domain comprises (i) a CDRL1 having an amino acid sequence GLSSGS-VSTSYYPS(SEQ ID NO:862); (ii) a CDRL2 having an amino acid sequence STNTRSS (SEQ ID NO:872); and (iii) a CDRL3 having an amino acid sequence VLYMGSGISYV (SEQ ID NO:882);

wherein the antibody or antigen-binding antibody fragment is optionally a full-length antibody, optionally a full-length IgG antibody, or an antibody fragment selected from the group consisting of a Fab, Fab', F(ab')$_2$, single-chain Fv (scFv), Fv, dsFv, diabody, Fd and Fd' fragment, Fab fragment, Fd fragment, scFv fragment, and a scFab fragment; or B. at least one at least one heavy chain variable domain and at least one light chain variable domain, wherein each heavy chain variable domain comprises three complementary determining regions (CDRs), CDRH1, CDRH2, and CDRH3, and each light chain variable domain comprises three CDRs, CDRL1, CDRL2, and CDRL3, wherein:
   a) CDRH1 comprises a modification of amino acid sequence SEQ ID NO:831, wherein one or more amino acids are different at positions S28, F29, T30, W33, I34, and/or G35 as compared to the corresponding positions in SEQ ID NO:831, wherein optionally one or more of the differences is selected from the group consisting of S28A, S28R, S28K, S28N, F29A, T30A, W33A, I34A, G35T, G35A and G35V;
   b) CDRH2 comprises a modification of amino acid sequence SEQ ID NO:845, wherein one or more amino acids are different at positions I50, I51, Y52, P52a, D54, S55, D56, and/or T57 as compared to the corresponding positions in SEQ ID NO:845, wherein optionally one or more of the differences is selected from the group consisting of I50A, I51A, Y52A, P52aA, D54A, S55G, D56A, T57D, and T57A;
   c) CDRH3 comprises a modification of amino acid sequence SEQ ID NO:852, wherein one or more amino acids are different at positions R95, G96, Y97, S98, Y99, G100, Y100a, D100b, and/or D101 as compared to the corresponding positions in SEQ ID NO:852, wherein optionally one or more of the differences is selected from the group consisting of R95A, G96K, G96R, G96L, G96D, G96T, Y97A, Y97H, S98A, Y99A, G100A, G100D, G100L, G100P, G100R, G100M, G100K, G100S, G100R, G100T, Y100aA, D100bA and D101A, and wherein optionally the differences are G96K/G100T;
   d) CDRL1 comprises a modification of amino acid sequence SEQ ID NO:862, wherein one or more amino acids are different at positions G24, L25, S26, S27, G27a, S27b, V27c, S28, T29, S30, Y31, Y32, and/or P33 as compared to the corresponding positions in SEQ ID NO:862, wherein optionally one or more of the differences is selected from the group consisting of G24A, G24R, G24L, L25A, S26A, S27A, G27aA, S27bA, V27cA, S28A, T29A, S30A, Y31A, Y32A, and P33A;
   e) CDRL2 comprises a modification of amino acid sequence SEQ ID NO:872, wherein one or more amino acids are different at positions S50, T51, N52, T53, R54, S55 and S56 as compared to the corresponding positions in SEQ ID NO:872, wherein optionally one or more of the differences is selected from the group consisting of S50A, S50F, S50G, S50C, S50R, S50L, S50M, S50V, S50P, S50T, S50H, S50Q, S50N, S50K, S50D, S50E, S50W, T51A, T51F, T51L, T51I, T51M, T51V, T51S, T51P, T51Y, T51H, T51Q, T51N, T51K, T51D, T51E, T51W, T51R, T51G, N52A, T53A, R54A, R54I, R54Y, R54D, R54G, S55A, S55F, S55L, S55I, S55M, S55V, S55P, S55T, S55Y, S55H, S55Q, S55N, S55K, S55D, S55E, S55W, S55R, S55G, and S56A; and
   f) CDRL3 comprises a modification of amino acid sequence SEQ ID NO:882, wherein one or more amino acids are different at positions V89, L90, Y91, M92, G93, S94, G95, I95a, and/or S95b as compared to the corresponding positions in SEQ ID NO:882, wherein optionally one or more of the differences is selected from the group consisting of V89A, V89P, V89T, V89S, V89L, V89R, V89C, V89E, V89W, V89N, V89I, V89G, V89H, L90A, Y91A, M92A, M92E, M92S, M92G, M92L, M92P, M92V, M92D, M92R, M92N, M92T, M92F, G93A, S94A, S94W, S94G, S94P, S94R, S94L, S94M, S94E, S94V, G94A, I95aA, and S95bA, and wherein optionally the differences are M92R/S94M or V89L/S94P; or
C. at least one at least one heavy chain variable domain and at least one light chain variable domain, wherein each heavy chain variable domain comprises an amino acid sequence of SEQ ID NO: 433 and each light chain variable domain comprises an amino acid sequence of SEQ ID NO:537.

10. A composition comprising a carrier, optionally a pharmaceutically acceptable carrier, and an isolated antibody or antigen-binding antibody fragment according to claim 1, wherein the composition is optionally formulated into a formulation for single dose administration or as a sustained release formulation, wherein the formulation is a gel, ointment, cream, paste, suppository, flush, liquid, suspension, aerosol, tablet, pill, or powder, which formulation is optionally suitable for systemic, parenteral, topical, oral, mucosal, intranasal, subcutaneous, aerosolized, intravenous, bronchial, pulmonary, vaginal, vulvovaginal, or esophageal administration, and wherein the composition is optionally further combined with anti-angiogenic agent, optionally an antagonist of vascular endothelial growth factor (VEGF), wherein the VEGF antagonist optionally is an anti-VEGF antibody or antigen-binding antibody fragment, wherein the anti-VEGF antibody optionally is bevacizumab.

* * * * *